US010894951B2

(12) United States Patent
Clarke et al.

(10) Patent No.: US 10,894,951 B2
(45) Date of Patent: *Jan. 19, 2021

(54) HETEROLOGOUS EXPRESSION OF SHORT-CHAIN MONOOXYGENASES IN MICROORGANISMS

(71) Applicant: Industrial Microbes, Inc., Emeryville, CA (US)

(72) Inventors: Elizabeth Jane Clarke, San Francisco, CA (US); Baolong Zhu, San Diego, CA (US); Derek Lorin Greenfield, Kensington, CA (US); Stephanie Rhianon Jones, Berkeley, CA (US); Noah Charles Helman, El Cerrito, CA (US)

(73) Assignee: Industrial Microbes, Inc., Emeryville, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/777,158

(22) PCT Filed: Nov. 17, 2016

(86) PCT No.: PCT/US2016/062623
§ 371 (c)(1),
(2) Date: May 17, 2018

(87) PCT Pub. No.: WO2017/087731
PCT Pub. Date: May 26, 2017

(65) Prior Publication Data
US 2019/0032028 A1 Jan. 31, 2019

Related U.S. Application Data

(60) Provisional application No. 62/320,725, filed on Apr. 11, 2016, provisional application No. 62/257,061, filed on Nov. 18, 2015, provisional application No. 62/270,039, filed on Dec. 21, 2015.

(51) Int. Cl.
*C12N 9/02* (2006.01)
*C12P 7/06* (2006.01)
*C12P 7/04* (2006.01)
*C12P 7/22* (2006.01)

(52) U.S. Cl.
CPC ......... *C12N 9/0073* (2013.01); *C12N 9/0071* (2013.01); *C12P 7/04* (2013.01); *C12P 7/06* (2013.01); *C12P 7/22* (2013.01); *C12Y 114/13025* (2013.01)

(58) Field of Classification Search
None
See application file for complete search history.

(56) References Cited

U.S. PATENT DOCUMENTS

| 9,267,158 B2 | 2/2016 | Coleman et al. |
| 9,399,783 B2 | 7/2016 | Coleman et al. |
| 9,745,603 B2 | 8/2017 | Coleman et al. |
| 2005/0176121 A1* | 8/2005 | Takeshita ............ C12P 7/04 435/155 |
| 2006/0051782 A1 | 3/2006 | Wood et al. |
| 2010/0257778 A1 | 10/2010 | Gaertner et al. |
| 2011/0097769 A1 | 4/2011 | Del Cardayre et al. |
| 2014/0013658 A1 | 1/2014 | Silverman et al. |
| 2014/0162327 A1 | 6/2014 | Sun et al. |
| 2014/0273128 A1 | 9/2014 | Coleman et al. |
| 2015/0104854 A1 | 4/2015 | Singh et al. |
| 2016/0160243 A1 | 6/2016 | Coleman et al. |
| 2016/0333359 A1 | 11/2016 | Song et al. |
| 2017/0037438 A1 | 2/2017 | Helman et al. |
| 2017/0152529 A1 | 6/2017 | Coleman et al. |
| 2017/0183638 A1 | 6/2017 | Jung et al. |
| 2017/0335351 A1 | 11/2017 | Coleman et al. |

FOREIGN PATENT DOCUMENTS

| EP | 1433856 | 6/2004 |
| WO | WO 2013/110797 | 8/2013 |
| WO | WO 2014/047209 | 3/2014 |
| WO | WO 2015/013295 | 1/2015 |
| WO | WO2015160848 | * 10/2015 |

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Franceschin et al. J Biol Chem. Jun. 29, 2012;287(27):22626-34. Epub May 17, 2012. (Year: 2012).*
Lee et al. Appl Microbiol Biotechnol. Feb. 2004;63(5):549-52. Epub Jun. 24, 2003. (Year: 2003).*
Accession P22869. Aug. 1, 1991. (Year: 1991).*
Accession P22869. Aug. 1, 1991. Alignment to SEQ ID No. 10 (Year: 1991).*
"Information on EC 1.14.13.25—methane monooxygenase (soluble)". BRENDA [online database]. Jan. 2018, [retrieved on Jan. 16, 2019]. Retreived from the Internet: URL <https://www.brenda-enzymes.org/enzyme.php?ecno=1.14.13.25>, 12 pages.
Ali et al., "Development and validation of promoter-probe vectors for the study of methane monooxygenase gene expression in *Methylococcus capsulatus* Bath", Microbiology. Mar. 2009; 155(Pt 3): 761-771.
Altschul et al., "Basic Local Alignment Search Tool", J Mol Biol. Oct. 5, 1990; 215(3): 403-410.
Amann et al., "Tightly regulated tac promoter vectors useful for the expression of unfused and fused proteins in *Escherichia coli*", Gene. Sep. 30, 1988; 69(2): 301-315.
Annaluru et al., "Total Synthesis of a Functional Designer Eukaryotic Chromosome", Science. Apr. 4, 2014; 344(6179): 55-58. Epub Mar. 27, 2014.

(Continued)

*Primary Examiner* — Christian L Fronda
(74) *Attorney, Agent, or Firm* — K&L Gates LLP

(57) ABSTRACT

Methods and compositions for the oxidation of short alkanes by engineered microorganisms expressing recombinant enzymes is described, along with methods of use.

12 Claims, 18 Drawing Sheets

Specification includes a Sequence Listing.

(56) References Cited

OTHER PUBLICATIONS

Antoine et al., "Cloning and over-expression in *Escherichia coli* of the gene encoding NADPH group III alcohol dehydrogenase from Thermococcus hydrothermalis. Characterization and comparison of the native and the recombinant enzymes", Eur J Biochem. Sep. 1999; 264(3): 880-889.
Araya-Garay et al., "Construction of a novel Pichia pastoris strain for production of xanthophylls", AMB Express. Apr. 25, 2012; 2(1): 24.
Ausubel et al. *Current Protocols in Molecular Biology*. New York, John Wiley & Sons Inc., 2012.
Baik et al., "Mechanistic Studies on the Hydroxylation of Methane by Methane Monooxygenase", Chem Rev. Jun. 2003; 103(6): 2385-2419.
Balasubramanian et al., "Oxidation of methane by a biological dicopper centre", Nature. May 6, 2010; 465(7294): 115-119. Epub Apr. 21, 2010.
Banerjee et al., "Soluble Methane Monooxygenase", Annu Rev Biochem. Jun. 20, 2019; 88: 409-431. Epub Jan. 11, 2019.
Beaucage et al., "Recent Advances in the Chemical Synthesis of RNA", Curr Protoc Nucleic Acid Chem. Sep. 2009; Chapter 2: Unit 2.16.1-31.
Berger et al. *Guide to Molecular Cloning Techniques*, vol. 152, 1st Ed. Academic Press, Inc., 1987.
Bhataya et al., "Metabolic engineering of Pichia pastoris X-33 for lycopene production", Process Biochem. Oct. 2009; 44(10): 1095-1102.
Blazyk, J., "Electron Transfer and Protein Engineering Studies of the Soluble Methane Monooxygenase from Methylococcus capsulatus (Bath)", Doctoral thesis submitted to the Department of Chemistry at the Massachusetts Institute of Technology, Sep. 2003, 312 pages.
Bollinger et al., "Engineering the Diiron Site of *Escherichia coli* Ribonucleotide Reductase Protein R2 to Accumulate an Intermediate Similar to $H_{peroxo}$, the Putative Peroxodiiron(III) Complex from the Methane Monooxygenase Catalytic Cycle", J Am Chem Soc. 1998, 120(5): 1094-1095. Epub Feb. 11, 1998.
Bornscheuer et al., "Survey of Protein Engineering Strategies", Curr Protoc Protein Sci. Nov. 2011; Chapter 26: Unit 26.7.1-14.
Borodina et al., "Mutagenesis of the 'Leucine Gate' to Explore the Basis of Catalytic Versatility in Soluble Methane Monooxygenase", Appl Environ Microbiol. Oct. 2007; 73(20): 6460-6467. Epub Aug. 17, 2007.
Brady, S.F., "Construction of soil environmental DNA cosmid libraries and screening for clones that produce biologically active small molecules", Nat Protoc. 2007; 2(5): 1297-1305.
Brandstetter et al., "Mutational and structural analyses of the regulatory protein B of soluble methane monooxygenase from Methylococcus capsulatus (Bath)", Chem Biol. Jul. 1999; 6(7): 441-449.
Braun et al., "14-3-3 (Bmh) Proteins Regulate Combinatorial Transcription following RNA Polymerase II Recruitment by Binding at Adr1-Dependent Promoters in *Saccharomyces Cerevisiae*", Mol Cell Biol. Feb. 2013; 33(4): 712-724. Epub Dec. 3, 2012.
Brouk et al., "Improving Biocatalyst Performance by Integrating Statistical Methods into Protein Engineering", Appl Environ Microbiol. Oct. 2010; 76(19): 6397-6403. Epub Aug. 13, 2010.
Burrows et al., "Substrate Specificities of the Soluble and Particulate Methane Mono-oxygenases of *Methylosinus trichosporium* OB3b", J Gen Microbiol. 1984; 130: 3327-3333.
Callaghan et al., "Residues near the N-terminus of protein B control autocatalytic proteolysis and the activity of soluble methane monooxygenase", Eur J Biochem. Apr. 2002; 269(7): 1835-1843.
Canada et al., "Directed Evolution of Toluene ortho-Monooxygenase for Enhanced 1-Naphthol Synthesis and Chlorinated Ethene Degradation", J Bacteriol. Jan. 2002; 184(2): 344-349.
Carvalho et al., "The remarkable Rhodococcus erythropolis", Appl Microbiol Biotechnol. Jun. 2005; 67(6): 715-726. Epub Feb. 15, 2005.

Cereghino et al., "Heterologous protein expression in the methylotrophic yeast Pichia pastoris", FEMS Microbiol Rev. Jan. 2000; 24(1): 45-66.
Cetinbas et al., "Catalysis of Protein Folding by Chaperones Accelerates Evolutionary Dynamics in Adapting Cell Populations", Plos Comput Biol. Nov. 2013; 9(11): e1003269. Epub Nov. 7, 2013.
Chistoserdova et al., "A genomic view of methane oxidation by aerobic bacteria and anaerobic archaea", Genome Biol. 2005; 6(2): 208. Epub Feb. 1, 2005.
Cho et al., "Defective Export of a Periplasmic Enzyme Disrupts Regulation of Fatty Acid Synthesis", J Biol Chem. Mar. 3, 1995; 270(9): 4216-4219.
Chong et al., "Improving Ethanol Tolerance of *Escherichia coli* by Rewiring Its Global Regulator cAMP Recepter Protein (CRP)", PLoS One. 2013; 8(2):e57628. Epub Feb. 28, 2013.
Clark et al., "*Escherichia coli* mutants with altered control of alcohol dehydrogenase and nitrate reductase", J Bacteriol. Jan. 1980; 141(1): 177-183.
Colby et al., "Some Properties of a Soluble Methane Monooxygenase from *Methylococcus capsulatus* Strain Bath", Biochem J. Aug. 1, 1976; 157(2): 495-497.
Colby et al., "The Soluble Methane Mono-oxygenase of *Methylococcus capsulatus* (Bath). Its ability to oxygenate n-alkanes, n-alkenes, ethers, and alicyclic, aromatic and heterocyclic compounds", Biochem J. Aug. 1, 1977; 165(2): 395-402.
Cole, P.A., "Chaperone-assisted protein expression", Structure. Mar. 15, 1996; 4(3): 239-242.
Coleman et al., "Hydrocarbon monooxygenase in Mycobacterium: recombinant expression of a member of the ammonia monooxygenase superfamily", ISME J. Jan. 2012; 6(1): 171-182. Epub Jul. 28, 2011.
Costas et al., "Dioxygen Activation at Mononuclear Nonheme Iron Active Sites: Enzymes, Models, and Intermediates", Chem Rev. Feb. 2004; 104(2): 939-986.
Coufal et al., "Sequencing and analysis of the *Methylococcus capsulatus* (Bath) soluble methane monooxygenase genes", Eur J Biochem. Apr. 2000; 267(8): 2174-2185.
Cregg et al., "Recombinant Protein Expression in Pichia pastoris", Mol Biotechnol. Sep. 2000; 16(1): 23-52.
Crombie et al., "Trace-gas metabolic versatility of the facultative methanotroph *Methylocella silvestris*", Nature. Jun. 5, 2014; 510(7503): 148-151. Epub Apr. 28, 2014.
Crombie, A., "Metabolism of methane and propane and the role of the glyoxylate bypass enzymes in *Methylocella silvestris* BL2", Doctoral thesis submitted to the School of Life Sciences at the University of Warwick, Coventry, UK, Sep. 2011, 315 pages.
Csáki et al., "Genes involved in the copper-dependent regulation of soluble methane monooxygenase of *Methylococcus capsulatus* (Bath): cloning, sequencing and mutational analysis", Microbiology. Jul. 2003; 149(Pt 7): 1785-1795.
Datsenko et al., "One-step inactivation of chromosomal genes in *Escherichia coli* K-12 using PCR Products", Proc Natl Acad Sci USA. Jun. 6, 2000; 97(12): 6640-6645.
De Vries et al., "Cloning, expression, and sequence analysis of the Bacillus methanolicus C1 methanol deydrogenase gene", J Bacteriol. Aug. 1992; 174(16): 5346-5353.
Dedysh et al., "Facultative Methane Oxidizers." in: *Handbook of Hydrocarbon and Lipid Microbiology*, K.N. Timmis (ed.), (Springer-Verlag, Berlin, Heidelberg, 2010), pp. 1968-1976.
Dedysh et al., "*Methylocella* Species Are Facultatively Methanotrophic", J Bacteriol. Jul. 2005; 187(13): 4665-4670.
Duan et al., "High-rate conversion of methane to methanol by *Methylosinus trichosporium* OB3b", Bioresour Technol. Aug. 2011; 102(15): 7349-7353. Epub May 6, 2011.
Duetz et al., "Using proteins in their natural environment: potential and limitations of microbial whole-cell hydroxylations in applied biocatalysis", Curr Opin Biotechnol. Aug. 2001; 12(4): 419-425.
Elango et al., "Crystal structure of the hydroxylase component of methane monooxygenase from *Methylosinus trichosporium* OB3b", Protein Sci. Mar. 1997; 6(3): 556-568.
Engler et al., "Combinatorial DNA assembly using Golden Gate cloning", Methods Mol Biol. 2013; 1073: 141-156. Abstract only.

(56) References Cited

OTHER PUBLICATIONS

Erijman et al., "Transfer-PCR (TPCR): A highway for DNA cloning and protein engineering", J Struct Biol. Aug. 2011; 175(2): 171-177. Epub Apr. 15, 2011.
Eroshin et al., "Influence of Amino Acids, Carboxylic Acids and Sugars on the Growth of *Methylococcus capsulatus* on Methane", J Appl Bacteriol. Dec. 1968; 31(4): 560-567.
Foster et al., "A Methane-Dependent Coccus, with Notes on Classification and Nomenclature of Obligate, Methane-Utilizing Bacteria", J Bacteriol. May 1996; 91(5): 1924-1931.
Fox et al., "Evidence for a µ-Oxo-bridged Binuclear Iron Cluster in the Hydroxylase Component of Methane Monooxygenase. Mössbauer and EPR studies", J Biol Chem. Aug. 5, 1988; 263(22): 10553-10556.
Fox et al., "Methane Monooxygenase from *Methylosinus trichosporium* OB3b", J Biol Chem. Jun. 15, 1989; 264(17): 10023-10033.
Furuya et al., "Reconstitution of Active Mycobacterial Binuclear Iron Monooxygenase Complex in *Escherichia coli*", Appl Environ Microbiol. Oct. 2013; 79(19): 6033-6039. Epub Jul. 26, 2013.
Furuya et al., "The mycobacterial binuclear iron monooxygenases require a specific chaperonin-like protein for functional expression in a heterologous host", FEBS J. Feb. 2013; 280(3): 817-826. Epub Jan. 2, 2013.
Gassner et al., "Component Interactions in the Soluble Methane Monooxygenase System from *Methylococcus capsulatus* (Bath)", Biochemistry. Sep. 28, 1999; 38(39): 12768-12785. Epub Sep. 11, 1999.
Ge et al., "Biological conversion of methane to liquid fuels: Status and opportunities", Biotechnol Adv. Dec. 2014; 32(8): 1460-1475. Epub Oct. 2, 2014.
Gentz et al., "Promoters Recognized by *Escherichia coli* RNA Polymerase Selected by Function: Highly Efficient Promoters from Bacteriophage T5", J Bacteriol. Oct. 1985; 164(1): 70-77.
Gibson et al., "Enzymatic assembly of DNA molecules up to several hundred kilobases", Nat Methods. May 2009; 6(5): 343-345. Epub Apr. 12, 2009.
Glass et al., "Trace metal requirements for microbial enzymes involved in the production and consumption of methane and nitrous oxide", Front Microbiol. Feb. 21, 2012; 3: 61. eCollection 2012.
Gou et al., "Functional expression of the particulate methane mono-oxygenase gene in recombinant Rhodococcus erythropolis", FEMS Microbiol Lett. Oct. 2006; 263(2): 136-141.
Gould et al., "Development of the Yeast Pichia pastoris as a Model Organism for a Genetic and Molecular Analysis of Peroxisome Assembly", Yeast. Aug. 1992; 8(8): 613-628.
Graham et al., "Factors Affecting Competition Between Type I and Type II Methanotrophs in Two-organism, Continuous-flow Reactors", Microb Ecol. Jan. 1993; 25(1): 1-17.
Green et al. *Molecular Cloning: A Laboratory Manual*, 4th ed. Cold Spring Harbor, New York, Cold Spring Harbor Laboratory Press, 2012.
Green et al., "Copper ions as inhibitors of protein C of soluble methane monooxygenase *Methylococcus capsulatus* (Bath)", Eur J Biochem. Nov. 15, 1985; 153(1): 137-144.
Green et al., "Substrate Specificity of Soluble Methane Monooxygenase. Mechanistic Implications", J Biol Chem. Oct. 25, 1989; 264(30): 17698-17703.
Green et al., "The Biosynthesis and Assembly of Protein A of Soluble Methane Monooxygenase of *Methylococcus capsulatus* (Bath)", J Biol Chem. Nov. 25, 1988; 263(33): 17561-17565.
Grosse et al., "Purification and Characterization of the Soluble Methane Monooxygenase of the Type II Methanotrophic Bacterium *Methylocystis* sp. Strain WI 14", Appl Environ Microbiol. Sep. 1999; 65(9): 3929-3935.
Haacke et al., "Chaperone over-expression in *Escherichia coli*: Apparent increased yields of soluble recombinant protein kinases are due mainly to soluble aggregates", Protein Expr Purif. Apr. 2009; 64(2): 185-193. Epub Nov. 11, 2008.
Hakemian et al., "The Biochemistry of Methane Oxidation", Annu Rev Biochem. 2007; 76: 223-241.

Han et al., "Partial Oxidative Conversion of Methane to Methanol Through Selective Inhibition of Methanol Dehydrogenase in Methanotrophic Consortium from Landfill Cover Soil", Appl Biochem Biotechnol. Nov. 2013; 171(6): 1487-1499. Epub Aug. 21, 2013.
Hanson et al., "Methanotrophic bacteria", Microbiol Rev. Jun. 1996; 60(2): 439-471.
Hartl et al., "Mitochondrial protein import", Biochim Biophys Acta. Jan. 18, 1989; 988(1): 1-45.
Hartmann et al. *Handbook of RNA Biochemistry: Second, Completely Revised and Enlarged Edition.* Weinheim, Germany, Wiley-VCH, Verlag GmbH & Co. KGaA, 2014.
Hartner et al., "Regulation of methanol utilisation pathway genes in yeasts", Microb Cell Fact. Dec. 14, 2006; 5: 39.
Haynes et al., "Rethinking biological activation of methane and conversion to liquid fuels", Nat Chem Biol. May 2014; 10(5): 331-339. Epub Apr. 17, 2014.
Henne et al., "Construction of Environmental DNA Libraries in *Escherichia coli* and Screening for the Presence of Genes Conferring Utilization of 4-Hydroxybutyrate", Appl Environ Microbiol. Sep. 1999; 65(9): 3901-3907.
Hoefman et al., "Customized media based on miniaturized screening improve growth rate and cell yield of methane-oxidizing bacteria of the genus *Methylomonas*", Antonie Van Leeuwenhoek. Feb. 2014; 105(2): 353-366. Epub Nov. 24, 2013.
Holmes et al., "Evolutionary ecology and multidisciplinary approaches to prospecting for monooxygenases as biocatalysts", Antonie Van Leeuwenhoek. Jun. 2008; 94(1): 75-84. Epub Feb. 19, 2008.
Hoover et al., "Bacterial production of free fatty acids from freshwater macroalgal cellulose", Appl Microbiol Biotechnol. Jul. 2011; 91(2): 435-446. Epub Jun. 4, 2011.
Hoover et al., "Isolation of Improved Free Fatty Acid Overproducing Strains of *Escherichia coli* via Nile Red Based High-Throughput Screening", Environ Prog Sustain Energy. Apr. 2012; 31(1): 17-23. Epub Nov. 17, 2011.
Huang et al., "Determination of the Carbon Kinetic Isotope Effects on Propane Hydroxylation Mediated by the Methane Monooxygenases from *Methylococcus capsulatus* (Bath) by Using Stable Carbon Isotopic Analysis", Chembiochem. Aug. 2, 2002; 3(8): 760-765.
Huang et al., "DFT study of the mechanism for methane hydroxylation by soluble methane monooxygenase (sMMO): effects of oxidation state, spin state, and coordination number", Dalton Trans. Jan. 28, 2013; 42(4): 1011-1023.
Iguchi et al., "Soluble and particulate methane monooxygenase gene clusters of the type I methanotroph *Methylovulum miyakonense* HT12", FEMS Microbiol Lett. Nov. 2010; 312(1): 71-76. Epub Sep. 15, 2010.
Im et al., "Characterization of a novel facultative *Methylocystis* species capable of growth on methane, acetate and ethanol", Environ Microbiol Rep. Apr. 2011; 3(2): 174-181. Epub Aug. 25, 2010.
Innis, M.A. *PCR Protocols: A Guide to Methods and Applications.* San Diego, CA, Academic Press, 1990. Abstract only.
Jahng et al., "Metal ions and chloramphenicol inhibition of soluble methane monooxygenase from *Methylosinus trichosporium* OB3b", Appl Microbiol Biotechnol. Jul. 1996; 45(6): 744-749.
Jahng et al., "Trichloroethylene and Chloroform Degradation by a Recombinant Pseudomonad Expressing Soluble Methane Monooxygenase from Methylosinus trichosporium OB3b", Appl Environ Microbiol. Jul. 1994; 60(7): 2473-2482.
Jiang et al., "Activation of the hydroxylase of sMMO from *Methylococcus capsulatus* (Bath) by hydrogen peroxide", Biochim Biophys Acta. Apr. 21, 1993; 1163(1): 105-112.
Jiang et al., "Chemical modification of the hydroxylase of soluble methane monooxygenase gives one form of the protein with significantly increased thermostability and another that functions well in organic solvents", Biochim Biophys Acta. Sep. 28, 1994; 1201(1): 76-84.
Jiang et al., "Methanotrophs: Multifunctional bacteria with promising applications in environmental bioengineering", Biochem Eng J. May 15, 2010; 49(3): 277-288.
Kalyuzhnaya et al., "Functional metagenomics of methylotrophs", Methods Enzymol. 2011; 495: 81-98.

(56) References Cited

OTHER PUBLICATIONS

Kalyuzhnaya et al., "Characterization of a Novel Methanol Dehydrogenase in Representatives of Burkholderiales: Implications for Environmental Detection of Methylotrophy and Evidence for Convergent Evolution", J Bacteriol. Jun. 2008; 190(11): 3817-3823. Epub Apr 4, 2008.
Kao et al., "Quantitative Proteomic Analysis of Metabolic Regulation by Copper Ions in *Methylococcus capsulatus* (Bath)", J Biol Chem. Dec. 3, 2004; 279(49): 51554-51560. Epub Sep. 22, 2004.
Kato et al., "The Physiological Role of the Ribulose Monophosphate Pathway in Bacteria and Archaea", Biosci Biotechnol Biochem. Jan. 2006; 70(1): 10-21.
Keel et al., "Large-scale native preparation of in vitro transcribed RNA", Methods Enzymol. 2009; 469: 3-25. Epub Nov. 17, 2009.
Kim et al., "Optimization of Lab Scale Methanol Production by Methylosinus trichosporium OB3b", Biotechnol Bioprocess Eng. Jun. 2010; 15(3): 476-480.
Leahy et al., "Evolution of the soluble diiron monooxygenases", FEMS Microbiol Rev. Oct. 2003; 27(4): 449-479.
Lee et al., "Control of substrate access to the active site in methane monooxygenase", Nature. Feb. 21, 2013; 494(7437): 380-384. Epub Feb. 10, 2013.
Lee et al., "Transient Intermediates of the Methane Monooxygenase Catalytic Cycle", J Biol Chem. Oct 15, 1993; 268(29): 21569-21577.
Lidstrom et al., "Methylotrophs: Genetics and Commercial Applications", Annu Rev Microbiol. 1990; 44: 27-58.
Lin-Cereghino et al., "Condensed protocol for competent cell preparation and transformation of the methylotrophic yeast *Pichia pastoris*", Biotechniques. Jan. 2005; 38(1): 44-48.
Lin-Cereghino et al., "Mxr1p, a Key Regulator of the Methanol Utilization Pathway and Peroxisomal Genes in Pichia pastoris", Mol Cell Biol. Feb. 2006; 26(3): 883-897.
Lipscomb, J., "Biochemistry of the Soluble Methane Monooxygenase", Annu Rev Microbiol. 1994; 48: 371-399.
Liu et al., "Kinetic and Spectroscopic Characterization of Intermediates and Component Interactions in Reactions of Methane Monooxygenase from *Methylococcus capsulatus* (Bath)", J Am Chem Soc. 1995; 117(41): 10174-10185.
Liu et al., "Spectroscopic Detection of Intermediates in the Reaction of Dioxygen with the Reduced Methane Monooxygenase Hydroxylase from *Methylococcus capsulatus* (Bath)", J Am Chem Soc. 1994; 116(16): 7465-7466.
Lloyd et al., "Heterologous expression of soluble methane monooxygenase genes in methanotrophs containing only particulate methane monooxygenase", Arch Microbiol. May-Jun. 1999; 171(6): 364-370.
Lloyd et al., "Inactivation of the regulatory protein B of soluble methane monooxygenase from *Methylococcus capsulatus* (Bath) by proteolysis can be overcome by a Gly to Gln modification", Eur J Biochem. Aug. 15, 1997; 248(1): 72-79.
Lloyd, J., "Heterologous Expression and Site-Directed Mutagenesis of Soluble Methane Monooxygenase", Doctoral thesis submitted to the Department of Biological Sciences at the University of Warwick, Nov. 1997, 355 pages.
Lontoh et al., "Methane and Trichloroethylene Degradation by *Methylosinus trichosporium* OB3b Expressing Particulate Methane Monooxygenase", Appl Environ Microbiol. Mar. 1998; 64(3): 1106-1114.
Lüers et al., "The Pichia pastoris Dihydroxyacetone Kinase is a PTS1-containing, but Cytosolic, Protein that is Essential for Growth on Methanol", Yeast. Jun. 15, 1998; 14(8): 759-771.
Lund et al., "Electron transfer reactions in the soluble methane monooxygenase of *Methylococcus capsulatus* (Bath)", Eur J Biochem. Mar. 1, 1985; 147(2): 297-305.
Luo et al., "Improved ethanol tolerance in *Escherichia coli* by changing the cellular fatty acids composition through genetic manipulation", Biotechnol Lett. Dec. 2009; 31(12): 1867-1871. Epub Aug. 15, 2009.
Lynch et al., "Mossbauer and EPR Studies of the Binuclear Iron Center in Ribonucleotide Reductase from *Escherichia coli*. A New Iron-to-Protein Stoichiometry", J Biol Chem. May 15, 1989; 264(14): 8091-8096.
Makhoba et al., "Molecular Chaperone Assisted Expression Systems: Obtaining Pure Soluble and Active Recombinant Proteins for Structural and Therapeutic Purposes", J Proteomics Bioinform. Jan. 2015; 8(9): 212-216.
Martinho et al., "Mossbauer Studies of the Membrane-Associated Methane Monooxygenase from *Methylococcus capsulatus* Bath: Evidence for a Diiron Center", J Am Chem Soc. Dec. 26, 2007; 129(51): 15783-15785. Epub Dec. 5, 2007.
McDonald et al., "Diversity of soluble methane monooxygenase-containing methanotrophs isolated from polluted environments", FEMS Microbiol Lett. Feb. 2006; 255(2): 225-232.
Megha et al., "GroEL-GroES assisted folding of multiple recombinant proteins simultaneously over-expressed in *Escherichia coli*", Int J Biochem Cell Biol. Jul. 2015; 64: 277-286. Epub May 6, 2015.
Meinhold et al., "Direct Conversion of Ethane to Ethanol by Engineered Cytochrome", Chembiochem. Oct. 2005; 6(10): 1765-1768.
Membrillo-Hernández et al., "Evolution of the adhE Gene Product of *Escherichia coli* from a Functional Reductase to a Dehydrogenase: Genetic and biochemical studies of the mutant proteins", J Biol Chem. Oct. 27, 2000; 275(43): 33869-33875.
Merkx et al., "Dioxygen Activation and Methane Hydroxylation by Soluble Methane Monooxygenase: A Tale of Two Irons and Three Proteins", Angew Chem Int Ed Engl. Aug. 3, 2001; 40(15): 2782-2807.
Merkx et al., "Why OrfY? Characterization of MMOD, a long overlooked component of the soluble methane monooxygenase from *Methylococcus capsulatus* (Bath)", J Biol Chem. Feb. 22, 2002; 277(8): 5858-5865. Epub Nov. 14, 2001.
Moon et al., "Metabolic engineering of Escherichia coli for the production of malic acid", Biochem Eng J. Jun. 2008; 40(2): 312-320.
Müller et al., "NMR Structure of the [2Fe-2S] Ferredoxin Domain from Soluble Methane Monooxygenase Reductase and Interaction with Its Hydroxylase", Biochemistry. Jan. 8, 2002; 41(1): 42-51.
Murrell et al., "Molecular biology and regulation of methane monooxygenase", Arch Microbiol. May-Jun. 2000; 173(5-6): 325-332.
Nazaries et al., "Methane, microbes and models: fundamental understanding of the soil methane cycle for future predictions", Environ Microbiol. Sep. 2013; 15(9): 2395-2417. Epub May 29, 2013.
Nguyen et al., "Reconstruction of Methanol and Formate Metabolic Pathway in Non-native Host for Biosynthesis of Chemicals and Biofuels", Biotechnol Bioprocess Eng. Aug. 2016; 21(4): 477-482.
Nichol et al., "Controlling the Activities of the Diiron Centre in Bacterial Monooxygenases: Lessons from Mutagenesis and Biodiversity", Eur J Inorg Chem. Jul. 2015; 2015(21): 3419-3431.
Nielsen et al., "Regulation of bacterial methane oxidation: transcription of the soluble methane mono-oxygenase operon of *Methylococcus capsulatus* (Bath) is repressed by copper ions", Microbiology. May 1996; 142(Pt 5): 1289-1296.
Nordlund et al., "The active site structure of methane monooxygenase is closely related to the binuclear iron center of ribonucleotide reductase", FEBS Lett. Aug. 3, 1992; 307(3): 257-262.
Oldenhuis et al., "Kinetics of Chlorinated Hydrocarbon Degradation by *Methylosinus trichosporium* OB3b and Toxicity of Trichloroethylene", Appl Environ Microbiol. Jan. 1991; 57(1): 7-14.
Orita et al., "Bifunctional enzyme fusion of 3-hexulose-6-phosphate synthase and 6-phospho-3-hexuloisomerase", Appl Microbiol Biotechnol. Aug. 2007; 76(2): 439-445. Epub May 23, 2007.
Orita et al., "The Archaeon Pyrococcus horikoshii Possesses a Bifunctional Enzyme for Formaldehyde Fixation via the Ribulose Monophosphate Pathway", J Bacteriol. Jun. 2005; 187(11): 3636-3642.
Orita et al., "The Ribulose Monophosphate Pathway Substitutes for the Missing Pentose Phosphate Pathway in the Archaeon Thermococcus kodakaraensis", J Bacteriol. Jul. 2006; 188(13): 4698-4704.

(56) References Cited

OTHER PUBLICATIONS

Palmer, M., "Optimization of Growth Conditions for Methanol Consumption in *Escherichia coli* Expressing Methylotrophic Genes", Doctoral thesis submitted to the Faculty of the University of Delaware, 2016, 41 pages.
Park et al., "Biological conversion of methane to methanol", Korean J Chem Eng. May 2013; 30(5): 977-987.
Patel et al., "Purification and Properties of the Hydroxylase Component of Methane Monooxygenase", J Bacteriol. May 1987; 169(5): 2313-2317.
Pilkington et al., "Soluble Methane Monooxygenase from *Methylococcus capsulatus* Bath", Methods Enzymol. 1990; 188: 181-190.
Purich et al. *The Enzyme Reference: A Comprehensive Guidebook to Enzyme Nomenclature, Reactions, and Methods*. Academic Press, 2002. Abstract only.
Ravi et al., "Mechanism of Assembly of the Tyrosyl Radical-Diiron(III) Cofactor of *E. Coli* Ribonucleotide Reductase: 1. Mössbauer Characterization of the Diferric Radical Precursor", J Am Chem Soc. 1994; 116(18): 8007-8014.
Redmond et al., "Identification of novel methane-, ethane-, and propane-oxidizing bacteria at marine hydrocarbon seeps by stable isotope probing", Appl Environ Microbiol. Oct. 2010; 76(19): 6412-6422. Epub Jul. 30, 2010.
Rosenzweig et al., "Geometry of the soluble methane monooxygenase catalytic diiron center in two oxidation states", Chem Biol. Jun. 1995; 2(6): 409-418.
Sazinsky et al., "Product Bound Structures of the Soluble Methane Monooxygenase Hydroxylase from *Methylococcus capsulatus* (Bath): Protein Motion in the α-Subunit", J Am Chem Soc. Apr. 27, 2005; 127(16): 5814-5825. Epub Apr. 2, 2005.
Schrader et al., "Methanol-based industrial biotechnology: current status and future perspectives of methylotrophic bacteria", Trends Biotechnol. Feb. 2009; 27(2): 107-115. Epub Dec. 26, 2008.
Senior et al., "The ICI Single Cell Protein Process", Biotechnol Lett. May 1980; 2(5): 205-210.
Sherman, F., "Getting Started with Yeast", Methods Enzymol. 2002; 350: 3-41.
Sirajuddin et al., "Enzymatic Oxidation of Methane", Biochemistry. Apr 14, 2015; 54(14): 2283-2294. Epub Apr. 1, 2015.
Smith et al., "Improved System for Protein Engineering of the Hydroxylase Component of Soluble Methane Monooxygenase", Appl Environ Microbiol. Nov. 2002; 68(11): 5265-5273.
Smith et al., "Metal reconstitution of particulate methane monooxygenase and heterologous expression of the pmoB subunit", Methods Enzymol. 2011; 495: 195-210.
Smith et al., "Mutagenesis of Soluble Methane Monooxygenase", Methods Enzymol. 2011; 495: 135-147.
Stafford et al., "rpoN, mmoR and mmoG, genes involved in regulating the expression of soluble methane monooxygenase in Methylosinus trichosporium OB3b", Microbiology. Jul. 2003; 149(Pt 7): 1771-1784.
Takeguchi et al., "Optimization of Methanol Biosynthesis by *Methylosinus trichosporium* OB3b: An Approach to Improve Methanol Accumulation", Appl Biochem Biotechnol. Dec. 1997; 68(3): 143-152.
Tamarit et al., "Identification of the Major Oxidatively Damaged Proteins in *Escherichia coli* Cells Exposed to Oxidative Stress", J Biol Chem. Jan. 30, 1998; 273(5): 3027-3032.
Tin Berg et al., "Dioxygen Activation in Soluble Methane Monooxygenase", ACC Chem Res. Apr. 19, 2011; 44(4): 280-288. Epub Mar. 10, 2011.
Ulrich et al., "Exponential Megapriming PCR (EMP) Cloning—Seamless DNA Insertion into Any Target Plasmid without Sequence Constraints", PLoS One. 2012; 7(12): e53360. Epub Dec. 31, 2012.
Urlacher et al., "Recent advances in oxygenase-catalyzed biotransformations", Curr Opin Chem Biol. Apr. 20006; 10(2): 156-161. Epub Feb. 20, 2006.
Valentine et al., "Mechanistic Studies of the Reaction of Reduced Methane Monooxygenase Hydroxylase with Dioxygen and Substrates", J Am Chem Soc. 1999; 121(16): 3876-3887. Epub Apr. 9, 1999.
Valentine et al., "Principles of small molecule activation by metalloenzymes as exemplified by the soluble methane monooxygenase from *Methylococcus capsulatus* (Bath)", J Chem Soc., Dalton Trans. 1997; 21: 3925-3931.
Van Der Rest et al., "A heat shock following electroporation induces highly efficient transformation of Corynebacterium glutamicum with xenogeneic plasmid DNA", Appl Microbiol Biotechnol. Oct. 1999; 52(4): 541-545.
Vazquez-Duhalt et al. *Petroleum Biotechnology: Developments and Persepctives*. Elsevier Science, 2004.
Vertès et al., "Manipulating Corynebacteria, from Individual Genes to Chromosomes", Appl Environ Microbiol. Dec. 2005; 71(12): 7633-7642.
Wang et al., "Coupling Oxygen Consumption with Hydrocarbon Oxidation in Bacterial Multicomponent Monooxygenases", Acc Chem Res. Sep. 15, 2015; 48(9): 2632-2639. Epub Aug. 21, 2015.
Wang et al., "Electron Transfer Control in Soluble Methane Monooxygenase", J Am Chem Soc. Jul. 9, 2014; 136(27): 9754-9762. Epub Jun. 24, 2014.
Ward et al., "Genomic Insights into Methanotrophy: The Complete Genome Sequence of Methylococcus capsulatus (Bath)", PLoS Biol. Oct. 2004; 2(10): e303. Epub Sep. 21, 2004.
Werpy et al., "Top Value Added Chemicals from Biomass. vol. I—Results of Screening for Potential Candidates from Sugars and Synthesis Gas", US Department of Energy, Aug. 2004.
West et al., "Functional expression in *Escherichia coli* of proteins B and C from soluble methane monooxygenase of *Methylococcus capsulatus* (Bath)", J Gen Microbiol. Jul. 1992; 138(7): 1301-1307.
Whitaker et al., "Synthetic methylotrophy: engineering the production of biofuels and chemicals based on the biology of aerobic methanol utilization", Curr Opin Biotechnol. Jun. 2015; 33: 165-175. Epub Mar. 19, 2015.
Whittington et al., "Crystal Structures of the Soluble Methane Monooxygenase Hydroxylase from *Methylococcus capsulatus* (Bath) Demonstrating Geometrical Variability at the Dinuclear Iron Active Site", J Am Chem Soc. Feb. 7, 2001; 123(5): 827-838.
Witthoff et al., "Metabolic Engineering of Corynebacterium glutamicum for Methanol Metabolism", Appl Environ Microbiol. Mar. 2015; 81(6): 2215-2225. Epub Jan. 16, 2015.
Wood, T. et al, "Active expression of soluble methane monooxygenase from *Methylosinus trichosporium* OB3b in heterologous hosts", Microbiology. Nov. 2002; 148(Pt 11): 3328-3329.
Woodland et al., "Purification and Characterization of Component A of the Methane Monooxygenase from *Methylococcus capsulatus* (Bath)", J Biol Chem. Jan. 10, 1984; 259(1): 53-59.
Xu et al., "The Heme Monooxygenase Cytochrome P450$_{cam}$ Can Be Engineered to Oxidize Ethane to Ethanol", Angew Chem Int Ed Engl. Jun. 27, 2005; 44(26): 4029-4032.
Yanase et al., "Cloning and sequence analysis of the gene encoding 3-hexulose-6-phosphate synthase from the methylotrophic bacterium, Methylomonas aminofaciens 77a, and its expression in *Escherichia coli*", FEMS Microbiol Lett. Jan. 15, 1996; 135(2-3): 201-205.
Yasueda et al., "Bacillus subtilis yckG and yckF Encode Two Key Enzymes of the Ribulose Monophosphate Pathway Used by Methylotrophs, and yckH Is Required for Their Expression", J Bacteriol. Dec. 1999; 181(23): 7154-7160.
Yoon, S., "Towards Practical Application of Methanotrophic Metabolism in Chlorinated Hydrocarbon Degradation, Greenhouse Gas Removal, and Immobilization of Heavy Metals", Doctoral thesis submitted at the University of Michigan, 2010, 158 pages.
Yuan et al., "Modification of the substrate specificity of an acyl-acyl carrier protein thioesterase by protein engineering", Proc Natl Acad Sci USA. Nov. 7, 1995; 92(23): 10639-10643.
Yurimoto et al., "The ribulose monophosphate pathway operon encoding formaldehyde fixation in a thermotolerant methylotroph, Bacillus brevis 51", FEMS Microbol Lett. Sep. 10, 2002; 214(2): 189-193.

(56) References Cited

OTHER PUBLICATIONS

Zelle et al., "Malic Acid Production by *Saccharomyces cerevisiae*: Engineering of Pyruvate Carboxylation, Oxaloacetate Reduction, and Malate Export", Appl Environ Microbiol. May 2008; 74(9): 2766-2777.

Zhang et al., "L-Malate Production by Metabolically Engineered *Escherichia coli*", Appl Environ Microbiol. Jan. 2011; 77(2): 427-434. Epub Nov. 19, 2010.

Zhang et al., "Metabolic evolution of energy-conserving pathways for succinate production in *Escherichia coli*", Proc Natl Acad Sci USA. Dec. 1, 2009; 106(48): 20180-20185. Epub Nov. 16, 2009.

International Search Report and Written Opinion dated Jul. 21, 2015, in International Patent Application No. PCT/US2015/025817, 12 pages.

International Search Report and Written Opinion dated Apr. 3, 2017, in International Patent Application No. PCT/US2016/062623, 13 pages.

Extended European Search Report dated Nov. 9, 2017, in European Patent Application No. 15780357.8, 9 pages.

Communication pursuant to Rule 164(1) EPC, Partial Supplementary European Search Report dated Mar. 14, 2019, in European Patent Application No. 16867180.8, 16 pages.

Extended European Search Report dated Jun. 25, 2019, in European Patent Application No. 16867180.8, 19 pages.

\* cited by examiner

```
TY7         ------------------MSRQSMSKAHKKITELSWEPTFATPAKRFGTDYTFDNAPKK
solimonas   --MAASNLAVKQALKNNPAPSSVDPQEVHKWLQDFTWD--FKEKAGKYPTKYDMDVNT-R
capsulatus  MALSTATKAATDALAANRAPTSVNAQEVHRWLQSFNWD--FKNNRTKYATKYKMANET-K
                         :  ..:.*::  . ..:.*:    *        ::  *.*  :         :

TY7         DPLKQILRSYFPMEEEKDSRVFGAMDGA-IRGNMFRQVQERWMEWQKLFLSIIPFPEISA
solimonas   EQFKLTAKEYARMESAKEERQFGTLLDGLDRLDAGNKVHPRWGEFMKLVANFLETGEYGA
capsulatus  EQFKLIAKEYARMEAVKDERQFGSLQDALTRLNAGVRVHPKWNETMKVVSNFLEVGEYNA
            : :*    :.*   **  *:.* **::  ..  *  :    :*:  :*  *  *:.  .::    * .*

TY7         ARAMPMAIDAVPNPEIHNGLAVQMIDEVRHSTIQMNLKRLYMNYYIDPAGFDMTEKA-FA
solimonas   LAGSALLWDTAQSPEQRNGYLAQVIDEVRHVNQCASVSYYYSKHYYDPAGFTNMRQLRAI
capsulatus  IAATGMLWDSAQAAEQKNGYLAQVLDEIRHTHQCAYVNYYFAKNGQDPAGHNDARRTRTI
               .   : *:.   *  :** .*::**:**       :.   :  :   ****.      ..:

TY7         NNYAGTIGRQFGEGFITGDAITAANIYLTVVAETAFTNTLFVAMPSEAAANGDYLLPTVF
solimonas   NPLYPGVKRAFGEGFLAGDAVES-SINLQLVAEACFTNPLIVALTEWAAANGDEITPTVF
capsulatus  GPLWKGMKRVFSDGFISGDAVEC-SLNLQLVGEACFTNPLIVAVTEWAAANGDEITPTVF
            .        :  * *.:**:.***:   .  .: *  :*.*:.***  *:**:  . ******  :  ****

TY7         HSVQSDESRHISNGYSILLMALSDEDNRQLLERDLRYAWWNNHRVVDAAIGTFIEYGTKD
solimonas   LSIETDELRHMANGYQTIVSIMNNPDTMKYLQTDLDNAFWTQHKFLTPFVGAALEYGSRF
capsulatus  LSIETDELRHMANGYQTVVSIANDPASAKYLNTDLNNAFWTQQKYFTPVLGMLFEYGSKF
            *:::**  **::***.  ::     .:    . : *: **     *:*.::: .      :*     :***::

TY7         RRKDRESYAEMWRRWIYDDYYRAYLIPLEKYGLVIPHDLIEESWKQIWEKGYVHEVAQFF
solimonas   ---KVEPWAKSWNRWVYEDWAGIWLGRLQQFGLKSPKCLADAKKDAVWAHH---DLALLA
capsulatus  ---KVEPWVKTWNRWVYEDWGGIWIGRLGKYGVESPRSLKDAKQDAYWAHH---DLYLLA
               . * :.: *.**:*:*:      ::    * ::*: *: *  :  .  *   :      ::   :

TY7         ATGWLANYWRIDSMTDEDFEWFEYKYPGWYDKYGKWWENYNRLSKPNG---HNPIVFE--
solimonas   FALWPLTGIRLELPDRQDMEWFEANYPGWYEHYGKIYEEWRALGFEDPRSGFSGAVWMLQ
capsulatus  YALWPTGFFRLALPDQEEMEWFEANYPGWYDHYGKIYEEWRARGCEDPSSGFIPLMWFIE
            :  *      *:       :::****  :*****::***  :*::..    .   :       .   ::

TY7         DVDYVYPAR---CWTCMSPCWSVRTLVTAEVDGQHRTYCHEVCRWTDVRGFPSDVPGRET
solimonas   RGHGIFIDHTSSLPFCPTLGKGALKPSFLEKNGKRFAFSEP-------HGERMWL-----
capsulatus  NNHPIYIDRVSQVPFCPSLAKGASTLRVHEYNGQMHTFSDQ-------WGERMWL-----
            . ::  :        * :   ...      * :*: :::..         *    :

TY7         PNMGRLVGKREWETLYHGWNWADVVSDMGFVRDDGKTMTPKPHLDLDPKKMWTLDHMRRC
solimonas   -QEPERYEFQNFFEQFEGWELSDLVKAAGGVRSDGKTLMAQPHLR--STDMWTLDDLKRI
capsulatus  -AEPERYECQNIFEQYEGRELSEVIAELHGLRSDGKTLIAQPHVR--GDKLWTLDDIKRL
                 .    ::    :.* :  ::::      :*.****:   :**:      ..:****.::*

TY7         PPLQ-SPNVLFNEMSDAERAAYVADYNKQGPAGRPAPQS*
solimonas   NFTVPDPMRILNWQPAH-----------------------
capsulatus  NCVFKNPVKAFN*---------------------------
                  .*    :*
```

FIGURE 18

HETEROLOGOUS EXPRESSION OF SHORT-CHAIN MONOOXYGENASES IN MICROORGANISMS

CROSS-REFERENCE TO RELATED APPLICATIONS

This application claims the benefit of U.S. Provisional Application No. 62/257,061 filed Nov. 18, 2015; Provisional Application No. 62/270,039 filed Dec. 21, 2015; and Provisional Application No. 62/320,725 filed Apr. 11, 2016, each of which is incorporated by reference herein in their entirety, including any drawings, as if they are part of the original application as filed.

This invention was made with Government support under SBIR Grant No. 1520425 awarded by the National Science Foundation. The Government has certain rights in this invention.

INTRODUCTION

Biological enzymes are catalysts capable of facilitating chemical reactions, often at ambient temperature and/or pressure. Some chemical reactions are catalyzed by either inorganic catalysts or certain enzymes, while others can be catalyzed by just one of these. For industrial uses, enzymes are advantageous catalysts if the alternative process requires expensive or energy-intensive conditions, such as high temperature or pressure, or if the complete process is to be integrated with other enzyme-catalyzed steps. Enzymes can also be engineered to control the range of raw materials or substrates required and/or the range of products formed.

Recent technological advances in synthetic biology have demonstrated the power and versatility of enzymatic pathways in living cells to convert organic molecules into industrial products. The petrochemical processes that currently manufacture these industrial products may be replaced by these biotechnological processes that can often provide the same products at a lower cost and with a lower environmental impact. The discovery of new pathways and enzymes that can operate and be engineered in genetically tractable microorganisms will further advance synthetic biology.

Sugar (including simple sugars, starches, carbohydrates, and sugar alcohols) is often a raw material for biological fermentations. But sugar has a relatively high cost as a raw material which severely limits the economic viability of the fermentation process. Although synthetic biology could expand to produce thousands of products that are currently petroleum-sourced, companies often must limit themselves to the production of select niche chemicals due to the high cost of sugar.

Short alkanes, such as methane and ethane, are significantly less expensive raw materials compared to sugar. Given the enormous supply of natural gas and the emergence of renewable methane-production technologies, short alkanes are expected to remain inexpensive for decades to come. Accordingly, industrial products made by engineered microorganisms from short alkanes, such as methane or ethane, should be less expensive to manufacture than those made by sugar and should remain so for decades.

Any biological system capable of converting short alkanes into industrial products must include an enzyme that can activate the alkane. Naturally occurring bacteria that can activate methane use dioxygen to convert methane to methanol. As an example, an enzyme capable of performing this reaction belongs to the class known as soluble diiron monooxygenases.

But, soluble diiron monooxygenases have been difficult to functionally express in industrially-relevant host cells. Successful functional expression of soluble diiron monooxygenases in an industrially relevant host would be a critical first step in a system capable of converting inexpensive methane or ethane into methanol or ethanol, respectively. Methanol or ethanol can be separated as an industrial product itself or used as a metabolic intermediate and further converted into other industrial products via enzyme-mediated pathways in a cell.

The invention provided herein is drawn to the ability to functionally express a useful enzyme in an industrial host.

BRIEF DESCRIPTION OF THE INVENTION

In a first aspect, a monooxygenase synthetic polynucleotide for a soluble diiron monooxygenase enzyme which can be expressed in a microorganism of interest or its complement is disclosed, comprising at least one monooxygenase coding region encoding a soluble diiron monooxygenase enzyme, the at least one monooxygenase coding region linked to at least one promoter which will function in the microorganism of interest. In an embodiment, the monooxygenase synthetic polynucleotide further comprises at least one protein folding chaperone coding region encoding at least one protein folding chaperone, the at least one protein chaperone coding region linked to at least one promoter which will function in the microorganism of interest.

An embodiment provides for a monooxygenase synthetic polynucleotide comprising a synthetic polynucleotide which is at least 60%, preferably about 65%, preferably about 70%, preferably about 75%, preferably about 80%, preferably about 85%, preferably about 90% or preferably about 95% identical to any one or more of the nucleotide sequences set forth in SEQ ID NO: 7 or SEQ ID NO: 9 or SEQ ID NO: 11 or SEQ ID NO: 13 or SEQ ID NO: 58 or SEQ ID NO: 60 or SEQ ID NO: 87 or SEQ ID NO: 89 or SEQ ID NO: 91 or SEQ ID NO: 93 or SEQ ID NO: 95 or SEQ ID NO: 97 or SEQ ID NO: 99 or SEQ ID NO: 101 or SEQ ID NO: 103 or SEQ ID NO: 105 or SEQ ID NO: 107 or SEQ ID NO: 109 or SEQ ID NO: 111 or SEQ ID NO: 113 or SEQ ID NO: 115 or SEQ ID NO: 117 or SEQ ID NO: 143 or SEQ ID NO: 145 or SEQ ID NO: 147 or SEQ ID NO: 149 or SEQ ID NO: 151 or SEQ ID NO: 153. An embodiment provides for a monooxygenase synthetic polynucleotide comprising a synthetic polynucleotide which is at least 60%, preferably about 65%, preferably about 70%, preferably about 75%, preferably about 80%, preferably about 85%, preferably about 90% or preferably about 95% identical to the nucleotide sequences set forth in SEQ ID NO: 7 and SEQ ID NO: 9 and SEQ ID NO: 11 and SEQ ID NO: 13 and SEQ ID NO: 58 and SEQ ID NO: 60. A further embodiment provides for a monooxygenase synthetic polynucleotide comprising a synthetic polynucleotide which is at least 60%, preferably about 65%, preferably about 70%, preferably about 75%, preferably about 80%, preferably about 85%, preferably about 90% or preferably about 95% identical to the complement of any one or more of the nucleotide sequences set forth in SEQ ID NO: 7 or SEQ ID NO: 9 or SEQ ID NO: 11 or SEQ ID NO: 13 or SEQ ID NO: 58 or SEQ ID NO: 60 or SEQ ID NO: 87 or SEQ ID NO: 89 or SEQ ID NO: 91 or SEQ ID NO: 93 or SEQ ID NO: 95 or SEQ ID NO: 97 or SEQ ID NO: 99 or SEQ ID NO: 101 or SEQ ID NO: 103 or SEQ ID NO: 105 or SEQ ID NO: 107 or SEQ ID NO: 109 or SEQ ID NO: 111 or SEQ ID NO: 113 or SEQ ID NO: 115 or SEQ ID NO: 117 or SEQ ID NO: 143 or SEQ ID NO: 145 or SEQ ID NO: 147 or SEQ ID NO: 149 or SEQ ID NO: 151 or SEQ ID NO: 153. A further embodiment provides for a monooxygenase synthetic polynucleotide comprising a synthetic polynucleotide which is at least 60%, preferably about 65%, preferably about 70%, preferably about 75%, preferably about 80%, preferably about 85%, preferably about 90% or preferably about 95% identical to the complement of the nucleotide sequences set forth in SEQ ID NO: 7 and SEQ ID NO: 9 and SEQ ID NO: 11 and SEQ ID NO: 13 and SEQ ID NO: 58 and SEQ ID NO: 60.

The disclosure is intended to encompass monooxygenase enzymes as disclosed herein, as well as subunits in any combination and amount.

A further embodiment provides for a monooxygenase synthetic polynucleotide comprising a synthetic polynucleotide which encodes a polypeptide which is at least 60%, preferably about 65%, preferably about 70%, preferably about 75%, preferably about 80%, preferably about 85%, preferably about 90% or preferably about 95% identical to any one or more of the amino acid sequences set forth in SEQ ID NO: 8 or SEQ ID NO: 10 or SEQ ID NO: 12 or SEQ ID NO: 14 or SEQ ID NO: 59 or SEQ ID NO: 61 or SEQ ID NO: 88 or SEQ ID NO: 90 or SEQ ID NO: 92 or SEQ ID NO: 94 or SEQ ID NO: 96 or SEQ ID NO: 98 or SEQ ID NO: 100 or SEQ ID NO: 102 or SEQ ID NO: 104 or SEQ ID NO: 106 or SEQ ID NO: 108 or SEQ ID NO: 110 or SEQ ID NO: 112 or SEQ ID NO: 114 or SEQ ID NO: 116 or SEQ ID NO: 118 or SEQ ID NO: 144 or SEQ ID NO: 146 or SEQ ID NO: 148 or SEQ ID NO: 150 or SEQ ID NO: 152 or SEQ ID NO: 154. A further embodiment provides for a monooxygenase synthetic polynucleotide comprising a synthetic polynucleotide which encodes a polypeptide which is at least 60%, preferably about 65%, preferably about 70%, preferably about 75%, preferably about 80%, preferably about 85%, preferably about 90% or preferably about 95% identical to the amino acid sequences set forth in SEQ ID NO: 8 and SEQ ID NO: 10 and SEQ ID NO: 12 and SEQ ID NO: 14 and SEQ ID NO: 59 and SEQ ID NO: 61. A further embodiment provides for a complement to a monooxygenase synthetic polynucleotide comprising a synthetic polynucleotide which encodes a polypeptide which is at least 60%, preferably about 65%, preferably about 70%, preferably about 75%, preferably about 80%, preferably about 85%, preferably about 90% or preferably about 95% to any one or more of the amino acid sequences set forth in SEQ ID NO: 8 or SEQ ID NO: 10 or SEQ ID NO: 12 or SEQ ID NO: 14 or SEQ ID NO: 59 or SEQ ID NO: 61 or SEQ ID NO: 88 or SEQ ID NO: 90 or SEQ ID NO: 92 or SEQ ID NO: 94 or SEQ ID NO: 96 or SEQ ID NO: 98 or SEQ ID NO: 100 or SEQ ID NO: 102 or SEQ ID NO: 104 or SEQ ID NO: 106 or SEQ ID NO: 108 or SEQ ID NO: 110 or SEQ ID NO: 112 or SEQ ID NO: 114 or SEQ ID NO: 116 or SEQ ID NO: 118 or SEQ ID NO: 144 or SEQ ID NO: 146 or SEQ ID NO: 148 or SEQ ID NO: 150 or SEQ ID NO: 152 or SEQ ID NO: 154. A further embodiment provides for a complement to a monooxygenase synthetic polynucleotide comprising a complement to a polynucleotide which encodes a polypeptide which is at least 60%, preferably about 65%, preferably about 70%, preferably about 75%, preferably about 80%, preferably about 85%, preferably about 90% or preferably about 95% to the amino acid sequences set forth in SEQ ID NO: 8 and SEQ ID NO: 10 and SEQ ID NO: 12 and SEQ ID NO: 14 and SEQ ID NO: 59 and SEQ ID NO: 61.

In a second aspect, a monooxygenase synthetic polynucleotide for a soluble diiron monooxygenase enzyme which can be expressed in a microorganism of interest, or its complement, is disclosed, comprising at least one monooxygenase coding region encoding a soluble diiron monooxygenase enzyme, the at least one monooxygenase coding region linked to at least one promoter which will function in the microorganism of interest, wherein the monooxygenase synthetic polynucleotide comprises at least one mutation in SEQ ID NO: 21 or SEQ ID NO: 22 or SEQ ID NO: 28 or SEQ ID NO: 29 or SEQ ID NO: 30 or SEQ ID NO: 31 or SEQ ID NO: 32 or SEQ ID NO: 33 or SEQ ID NO: 34 or SEQ ID NO: 35 or SEQ ID NO: 36 or SEQ ID NO: 37 or SEQ ID NO: 46, wherein the at least one mutation increases specificity for a monooxygenase substrate and/or increases production of a chemical as compared, respectively, to SEQ ID NO: 21 or SEQ ID NO: 22 or SEQ ID NO: 28 or SEQ ID NO: 29 or SEQ ID NO: 30 or SEQ ID NO: 31 or SEQ ID NO: 32 or SEQ ID NO: 33 or SEQ ID NO: 34 or SEQ ID NO: 35 or SEQ ID NO: 36 or SEQ ID NO: 37 or SEQ ID NO: 46. In an embodiment, the monooxygenase synthetic polynucleotide comprises at least one mutation in any of the sequences disclosed herein, wherein the at least one mutation increases specificity for a monooxygenase substrate and/or increases production of a chemical as opposed to its respective wild type sequence. In an embodiment, the at least one mutation comprises one or more mutations being one or more of a Y or S substitution for K at position 61, an N for E substitution at position 240 and/or an A or T substitution for S at position 421 in SEQ ID NO: 10; an M for L at position 67 in SEQ ID NO: 12; and T for P at position 167 in SEQ ID NO: 14.

In an embodiment, the monooxygenase synthetic polynucleotide further comprises at least one accessory protein or protein folding chaperone coding region encoding at least one protein folding chaperone, the at least one protein folding chaperone coding region linked to at least one promoter which will function in the microorganism of interest.

In a third aspect, a dehydrogenase synthetic polynucleotide for at least one alcohol dehydrogenase and/or an acetaldehyde dehydrogenase which can be expressed in a microorganism of interest or its complement is disclosed, comprising at least one alcohol dehydrogenase and/or an acetaldehyde dehydrogenase coding region encoding an alcohol dehydrogenase and/or an acetaldehyde dehydrogenase, the at least one alcohol dehydrogenase and/or an acetaldehyde dehydrogenase coding region linked to at least one promoter which will function in the microorganism of interest. In an embodiment, the alcohol dehydrogenase and/or an acetaldehyde dehydrogenase is at least one, two or all of mdh from *Bacillus stearothermophilus* (SEQ ID NO: 51), mhpF from *Escherichia coli* (SEQ ID NO: 53) or acdH from *Clostridium kluyveri* (SEQ ID NO: 55). In an embodiment, the dehydrogenase synthetic polynucleotide comprises a mutation of a T for an A at position 267 and a K for an E at position 568 of the adhE gene of *Escherichia coli* as set forth in SEQ NO: 49.

Another embodiment provides for a dehydrogenase synthetic polynucleotide which comprises a synthetic polynucleotide which is at least 60%, preferably about 65%, preferably about 70%, preferably about 75%, preferably about 80%, preferably about 85%, preferably about 90% or preferably about 95% identical to the nucleotide sequence set forth in SEQ ID NO: 48 or SEQ ID NO: 50 or SEQ ID NO: 52 or SEQ ID NO: 54. A further embodiment provides for a dehydrogenase synthetic polynucleotide which comprises a synthetic polynucleotide which is at least 60%, preferably about 65%, preferably about 70%, preferably about 75%, preferably about 80%, preferably about 85%, preferably about 90% or preferably about 95% complementary to the nucleotide sequence set forth in SEQ ID NO: 48 or SEQ ID NO: 50 or SEQ ID NO: 52 or SEQ ID NO: 54.

A further embodiment provides for a dehydrogenase synthetic polynucleotide which comprises a synthetic polynucleotide which encodes a polypeptide which is at least 60%, preferably about 65%, preferably about 70%, preferably about 75%, preferably about 80%, preferably about 85%, preferably about 90% or preferably about 95% identical to the amino acid sequence set forth SEQ ID NO: 49 or SEQ ID NO: 51 or SEQ ID NO: 53 or SEQ ID NO: 55. A further embodiment provides for a complement to a dehydrogenase synthetic polynucleotide which comprises a synthetic polynucleotide complementary to a polynucleotide which encodes a polypeptide which is at least 60%, preferably about 65%, preferably about 70%, preferably about 75%, preferably about 80%, preferably about 85%, preferably about 90% or preferably about 95% to the amino acid sequence set forth in SEQ ID NO: 49 or SEQ ID NO: 51 or SEQ ID NO: 53 or SEQ ID NO: 55.

In an embodiment, the monooxygenase synthetic polynucleotide and/or dehydrogenase synthetic polynucleotide is a synthetic polynucleotide comprising any one of the sequences set forth herein. In an embodiment, the synthetic polynucleotide additionally comprises at least one promoter operably linked to any one or more of the synthetic polynucleotides disclosed herein. In an embodiment, the promoter is at least one of pBAD, pTrc, ptac, pLac, pT5 and/or J23116. In an embodiment, the promoter is at least one of pADH1, pTEF1, pTEF2, pGAP and/or pGCW14. Any promoter disclosed herein or known to one skilled in the art should also be considered part of the disclosure of this application. In an embodiment, random mutations are introduced in the promoter regions using degenerate primers. In an embodiment, one or more terminators are incorporated into the expression construct.

In an embodiment, the synthetic polynucleotide comprises one or more of plasmids pBZ13 (SEQ ID NO: 15), pBZ15 (SEQ ID NO: 16), pBZ21 (SEQ ID NO: 17), pBZ23 (SEQ ID NO: 18), pBZ4 (SEQ ID NO: 19), pDG5 (SEQ ID NO: 21), pDG6 (SEQ ID NO: 22), pLC100 (SEQ ID NO: 23), pLC12 (SEQ ID NO: 24), pLC37 (SEQ ID NO: 25), pLC39 (SEQ ID NO: 26), pLC99 (SEQ ID NO: 27), pNH100 (SEQ ID NO: 28), pNH104 (SEQ ID NO: 29), pNH132 (SEQ ID NO: 30), pNH157 (SEQ ID NO: 31), pNH158 (SEQ ID NO: 32), pNH160 (SEQ ID NO: 33), pNH166 (SEQ ID NO: 34), pNH167 (SEQ ID NO: 35), pNH172 (SEQ ID NO: 36), pNH173 (SEQ ID NO: 37), pNH177 (SEQ ID NO: 38), pNH178 (SEQ ID NO: 39), pNH180 (SEQ ID NO: 40), pNH181 (SEQ ID NO: 41), pNH185 (SEQ ID NO: 42), pNH187 (SEQ ID NO: 43), pNH188 (SEQ ID NO: 44), pNH225 (SEQ ID NO: 45) and/or pNH238 (SEQ ID NO: 46) or any other synthetic polynucleotide or synthetic polypeptide disclosed herein.

The disclosure is intended to include any complement sequences to the sequences set forth herein. The disclosure is also intended to encompass any polypeptides or synthetic polypeptides encoded by the synthetic polynucleotides of the current invention. Where synthetic sequences of the invention are disclosed, the invention is meant to encompass any sequence that has an identity to the sequences, as set forth herein.

The disclosure also provides synthetic microorganisms engineered to functionally express a monooxygenase enzyme and/or dehydrogenase enzyme that converts a wide range of organic substrates into an even broader range of products. The disclosure provides synthetic microorganisms engineered to consume molecules containing carbon, such as alkane or other molecules, such molecules as methane or methanol, ethane or ethanol. The invention also provides microorganisms engineered to convert methane and/or methanol or ethane and/or ethanol into industrial products.

In a fourth aspect, disclosed herein is a synthetic microorganism comprising at least one exogenous synthetic polynucleotide, wherein the synthetic polynucleotide comprises at least one of the synthetic polynucleotides set forth herein. In an embodiment, the synthetic polypeptide is heterologous. The microorganism is intended to encompass prokaryotic cells or eukaryotic cells, such as yeast and fungi, and also intended to include archaea. In one embodiment, the microorganism is at least one of *Escherichia coli, Bacillus subtilis, Bacillus methanolicus, Pseudomonas putida, Saccharomyces cerevisiae, Pichia pastoris, Pichia methanolica, Salmonella enterica, Corynebacterium glutamicum, Klebsiella oxytoca, Anaerobiospirillum succiniciproducens, Actinobacillus succinogenes, Mannheimia succiniciproducens, Rhizobium etli, Gluconobacter oxydans, Zymomonas mobilis, Lactococcus lactis, Lactobacillus plantarum, Streptomyces coelicolor, Clostridium acetobutylicum, Pseudomonas fluorescens, Schizosaccharomyces pombe, Kluyveromyces lactis, Kluyveromyces marxianus, Aspergillus terreus, Aspergillus niger,* and *Candida utilis*. In an embodiment, the microorganism is at least one of *Escherichia coli, Saccharomyces cerevisiae, Pichia pastoris, Bacillus methanolicus, Bacillus subtilis* or *Corynebacterium glutamicum*. In an embodiment, the microorganism is *Escherichia coli*. In an embodiment, the microorganism is *Pichia pastoris*. In an embodiment, the microorganism is *Saccharomyces cerevisiae*. In an embodiment, the microorganism is *Corynebacterium glutamicum*. In an embodiment, the microorganism is *Bacillus methanolicus*.

In an embodiment, the synthetic microorganism has improved growth on or is capable of growth on a monooxygenase substrate, alcohol dehydrogenase substrate and/or an acetaldehyde dehydrogenase substrate as a sole or major carbon source. In an embodiment, the substrate is at least one of methane, ethane, propane, butane, pentane, hexane, heptane, octane, 2-methylpropane, 2,3-dimethylpentane, propene (propylene), but-1-ene, cis-but-2-ene, trans-but-2-ene, cyclohexane, methylene cyclohexane, □-pinene, adamantane, cis-1,4-dimethylcyclohexane, cis-1,3-dimethylcyclohexane, trichloroethene, vinyl chloride, 1,1-dichloroethene, trifluoroethylene, chlorotrifluoroethylene, tribromoethylene, benzene, toluene, ethylbenzene, styrene, pyridine, naphthalene, biphenyl, 2-hydroxybiphenyl, 2-methylbiphenyl, 2-chlorobiphenyl, 2-bromobiphenyl, 2-iodobiphenyl, chloromethane, dichloromethane, bromomethane, nitromethane, methanethiol, methanol, ethanol, diethyl ether, carbon monoxide, cyclohexene, dimethyl ether, difluoromethane, fluorobenzene, fluoromethane, isopentane, methylamine, methylcyanide, nitrobenzene, phenylalanine or xylene. In an embodiment, the monooxygenase substrate is methane, ethane, propane, butane or naphthalene. In an embodiment, the substrate is methanol or ethanol. Other substrates can be found, for example, without limitation, in Vazquez-Duhalt and Quintero-Ramirez, *Petroleum Biotechnology,* 2004; Green and Dalton, Substrate Specificity of Soluble Methane Monooxygenase, J. Biol. Chem., Vol. 264 No. 30, pp. 17698-17703, 1989; BRENDA online database http://www.brenda-enzymes.org/enzyme.php?ecno=1.14.13.25, which is incorporated by reference herein including any drawings. In an embodiment, the substrate is ethane. In an embodiment, the substrate is ethane and the at least one mutation increases specificity for ethane.

In an embodiment, the synthetic microorganism produces a chemical. In an embodiment, the chemical is at least one of dicarboxylic acid, malic acid, fumaric acid, succinic acid, malic acid salt, fumaric acid salt, succinic acid salt, L-malic acid, D-malic acid, maleic acid, lactic acid, adipic acid, 1,3-propanediol, 2,3-butanediol, 1,4-butanediol, butadiene, fatty acid derivatives, fatty alcohols, fatty acids, fatty acid esters, fatty acid methyl esters, fatty acid ethyl esters, branched fatty acids, branched fatty acid derivatives, omega-3 fatty acids, isoprenoids, isoprene, farnesene, farnesene, squalene, squalane, carotenoids, any or all of the amino acids, alanine, arginine, asparagine, aspartic acid, cysteine, glutamic acid, monosodium glutamate, glutamine, glycine, histidine, isoleucine, leucine, lysine, methionine, phenylalanine, threonine, tryptophan, valine, ornithine, proline, selenocysteine, serine, tyrosine, ethanol, propanol, 1-butanol, 2-butanol, isobutanol (2-methylpropan-1-ol), alcohols, alkanes, alkenes, olefins, animal feed additives, mixtures of amino acids, and proteins. Other examples of chemicals include, but are not limited to, ethanol, propanol, isopropanol, butanol, fatty alcohols, fatty acid esters, ethyl esters, wax esters; hydrocarbons and alkanes such as propane, octane, diesel, Jet Propellant 8 (JP8); terephthalate, 1,3-propanediol, 1,4-butanediol, acrylate, adipic acid, ε-caprolactone, isoprene, caprolactam, and polymers of these, plus other polymers, such as polyols, polyhydroxyalkanoates (PHA), poly-beta-hydroxybutyrate (PHB), rubber; commodity chemicals such as lactate, docosahexaenoic acid (DHA), 3-hydroxypropionate, γ-valerolactone, lysine, serine, aspartate, aspartic acid, sorbitol, ascorbate, ascorbic acid, isopentenol, lanosterol, omega-3 DHA, lycopene, itaconate, 1,3-butadiene, ethylene, propylene, succinate, citrate, citric acid, glutamate, malate, 3-hydroxypropionic acid (HPA), lactic acid, THF, gamma butyrolactone, pyrrolidones, hydroxybutyrate, glutamic acid, levulinic acid, acrylic acid, malonic acid; specialty chemicals such as carotenoids, isoprenoids, itaconic acid; pharmaceuticals and pharmaceutical intermediates such as 7-aminodeacetoxycephalosporanic acid (7-ADCA)/cephalosporin, erythromycin, polyketides, statins, paclitaxel, docetaxel, terpenes, peptides, steroids, omega fatty acids and other such suitable products of interest. Such products are useful in the context of biofuels, industrial and specialty chemicals, as intermediates used to make additional products, such as nutritional supplements, nutraceuticals, polymers, paraffin replacements, personal care products and pharmaceuticals. Other examples of chemicals include, without limitation, all compounds that can be produced with the methods set forth herein. Such compounds are intended to include all molecules that can be constructed with the methods set forth herein including, for example without limitation, all organic and inorganic molecules that can be made with the methods set forth herein. The term chemical is intended to include natural and non-natural compounds. Examples of natural molecules include, but are not limited to, amino acids, nucleic acids, nucleotides and polynucleotides and all related biological molecules. Non-natural compounds include, but are not limited to, amino acids and nucleotides that are modified in a way differently than they are normally modified in biological systems (such as, for example, without limitation, non-natural amino acids). In an embodiment, the chemical is methanol, ethanol, propanol, butanol, or naphthol. In another embodiment, the chemical is succinate, malate, fatty acids, lysine, and/or glutamate. In an embodiment, the chemical is 3-hydroxypropionate or a polymer of 3-hydroxypropionate.

In an embodiment, the microorganism comprises *Escherichia coli* and the synthetic microorganism is *Escherichia coli* and the monooxygenase synthetic polynucleotide encodes for a soluble diiron monooxygenase enzyme or one, some or any of its subunits. In an embodiment, the soluble diiron monooxygenase enzyme comprises a methane monooxygenase or an ethane monooxygenase. In an embodiment, the synthetic microorganism comprises *Escherichia coli* that has been transformed with the synthetic polynucleotide and the synthetic microorganism has improved growth on ethane or consumes ethane as a sole carbon source or as a major carbon source as compared to a microorganism that has not been transformed with the monooxygenase synthetic polynucleotide. In an embodiment, the synthetic microorganism comprises *Escherichia coli* that has been transformed with the monooxygenase synthetic polynucleotide, the monooxygenase substrate is ethane and the chemical is ethanol. In an embodiment, the synthetic microorganism comprises *Escherichia coli* that has been transformed with the monooxygenase synthetic polynucleotide, the araBAD gene has been deleted, the substrate comprises ethane and the chemical comprises ethanol. In an embodiment, the synthetic microorganism comprises *Escherichia coli* that has been transformed with the monooxygenase synthetic polynucleotide, the monooxygenase substrate comprises methane and the chemical comprises methanol. In an embodiment, the synthetic microorganism comprises *Escherichia coli* that has been transformed with the monooxygenase synthetic polynucleotide, the araBAD gene has been deleted, the substrate comprises methane and the chemical comprises methanol. In an embodiment, the synthetic microorganism comprises *Escherichia coli* that has been transformed with the monooxygenase synthetic polynucleotide, the monooxygenase substrate comprises naphthalene and the chemical comprises 1-naphthol. In an embodiment, the synthetic microorganism comprises *Escherichia coli* that has been transformed with the monooxygenase synthetic polynucleotide, the monooxygenase substrate comprises ethane and the chemical comprises a fatty acid. In an embodiment, the synthetic microorganism comprises *Escherichia coli* that has been transformed with the monooxygenase synthetic polynucleotide, the monooxygenase substrate comprises ethane and the chemical comprises succinate.

In an embodiment, the microorganism comprises *Escherichia coli* and the synthetic microorganism is *Escherichia coli* and the monooxygenase synthetic polynucleotide encodes for a soluble diiron monooxygenase enzyme which encodes a polypeptide which is at least 60%, preferably about 65%, preferably about 70%, preferably about 75%, preferably about 80%, preferably about 85%, preferably about 90% or preferably about 95% identical to the amino acid sequences set forth in SEQ ID NO: 8 and SEQ ID NO: 10 and SEQ ID NO: 12 and SEQ ID NO: 14 and SEQ ID NO: 59 and SEQ ID NO: 61. In an embodiment, the microorganism comprises *Escherichia coli* and the synthetic microorganism is *Escherichia coli* and the monooxygenase synthetic polynucleotide encodes for a soluble diiron monooxygenase enzyme which encodes a polypeptide that has the amino acid sequences set forth in SEQ ID NO: 8 and SEQ ID NO: 10 and SEQ ID NO: 12 and SEQ ID NO: 14 and SEQ ID NO: 59 and SEQ ID NO: 61 and the at least one protein folding chaperone has the amino acid sequences set forth in SEQ ID NO: 63 and SEQ ID NO: 65 and SEQ ID NO: 67 and SEQ ID NO: 69.

In an embodiment of anything disclosed herein, the at least one protein folding chaperone comprises at least one heterologous groES and/or groEL. In an embodiment, the at least one protein folding chaperone comprises at least one protein which is at least 60%, preferably about 65%, preferably about 70%, preferably about 75%, preferably about 80%, preferably about 85%, preferably about 90% or preferably about 95% identical to the amino acid sequence set forth in SEQ ID NO: 63 or SEQ ID NO: 65 or SEQ ID NO: 67 or SEQ ID NO: 69 or SEQ ID NO: 120 or SEQ ID NO: 122 or SEQ ID NO: 124 or SEQ ID NO: 126 or SEQ ID NO: 128 or SEQ ID NO: 130 or SEQ ID NO: 132 or SEQ ID NO: 134 or SEQ ID NO: 136 or SEQ ID NO: 138 or SEQ ID NO: 140 or SEQ ID NO: 142. In an embodiment, the at least one protein folding chaperone comprises at least one protein which is at least 60%, preferably about 65%, preferably about 70%, preferably about 75%, preferably about 80%, preferably about 85%, preferably about 90% or preferably about 95% identical to the amino acid sequence of any sequence disclosed herein. In an embodiment for any disclosure provided herein, the at least one protein folding chaperone comprises at least two protein folding chaperones. In an embodiment for any disclosure provided herein, the at least one protein folding chaperone comprises a protein that is a GroES and/or GroEL from at least one of *Escherichia coli*, *Methylocaldum* sp175, *Methylococcus capsulatus* or *Solimonas aquatica* DSM 25927. In an embodiment for any disclosure provided herein, the at least one protein folding chaperone comprises *Escherichia coli* groES, and/or GroEL and *Methylococcus capsulatus* GroES and/or GroEL-2. In an embodiment for any disclosure herein, protein folding chaperones are each selectively, completely or in particular combinations co-expressed to improve monooxygenase activity. In an embodiment, protein folding chaperones are each selectively, completely or in particular combinations overexpressed to improve monooxygenase activity. In an embodiment of anything disclosed herein, the soluble diiron monooxygenase enzyme is a methane monooxygenase or an ethane monooxygenase. In an embodiment for any disclosure provided herein, the monooxygenase is a monooxygenase from at least one of *Solimonas aquatica* DSM 25927, *Methyloferula stellata*, *Methylocaldum* sp 175, *Methylococcus capsulatus*, *Methylocella silvestris* and/or *Methylosinus trichosporium*. In an embodiment, the monooxygenase is any one or more monooxygenase(s) from Table 16. In an embodiment for any disclosure herein, monooxygenase(s) are each selectively, completely or in particular combinations chosen and combined to improve overall monooxygenase activity. In an embodiment for any disclosure provided herein, the monooxygenase and/or protein folding chaperones are any proteins homologous enough to be suitable for the present disclosure and that may be utilized in any amount and combination which would be suitable to carry out the claimed invention.

In an embodiment, the microorganism comprises *Escherichia coli*, the synthetic microorganism comprises *Escherichia coli* and the dehydrogenase synthetic polynucleotide encodes for an alcohol dehydrogenase and/or an acetaldehyde dehydrogenase. In an embodiment, the alcohol dehydrogenase and/or an acetaldehyde dehydrogenase comprises at least one, two or all of Mdh from *Bacillus stearothermophilus* (SEQ ID NO: 51), MhpF from *Escherichia coli* (SEQ ID NO: 53) or AcdH from *Clostridium kluyveri* (SEQ ID NO: 55). In an embodiment, the protein comprises a mutation of a T for an A at position 267 and a K for an E at position 568 of the protein encoded by the *Escherichia coli* adhE gene of the amino acid sequence set forth in SEQ NO: 49. In an embodiment, the synthetic microorganism comprises an *Escherichia coli* that has been transformed with the dehydrogenase synthetic polynucleotide and the synthetic microorganism has improved growth on ethanol or consumes ethanol as a sole carbon source or as a major carbon source as compared to a microorganism that has not been transformed with the dehydrogenase synthetic polynucleotide. In an embodiment, the synthetic microorganism comprises *Escherichia coli* that has been transformed with the dehydrogenase synthetic polynucleotide, the substrate is ethanol and the chemical is a fatty acid. In an embodiment, the synthetic microorganism comprises *Escherichia coli* that has been transformed with the dehydrogenase synthetic polynucleotide, the araBAD gene has been deleted, the synthetic microorganism has been transformed with the fatB1 gene from *Umbellularia californica*, the substrate comprises ethanol and the chemical comprises a fatty acid. In an embodiment, the synthetic microorganism comprises *Escherichia coli* that has been transformed with the dehydrogenase synthetic polynucleotide, the substrate is ethanol and the chemical is succinate. In a preferred embodiment, the synthetic microorganism comprises *Escherichia coli* that has been transformed with the dehydrogenase synthetic polynucleotide and the araBAD, iclR, and/or sdhAB genes have been deleted and/or their expression has been reduced, the substrate comprises ethanol and the chemical comprises succinate. In an embodiment for any disclosure herein, dehydrogenase(s) are each selectively, completely or in particular combinations chosen and combined to improve overall dehydrogenase activity.

In an embodiment for any disclosure provided herein, the microorganism comprises *Corynebacterium glutamicum*. In an embodiment, the microorganism comprises *Corynebacterium glutamicum*, the synthetic microorganism comprises *Corynebacterium glutamicum* and the monooxygenase synthetic polynucleotide encodes for a soluble diiron monooxygenase enzyme. In an embodiment, the soluble diiron monooxygenase enzyme comprises a methane monooxygenase or an ethane monooxygenase. In an embodiment, the synthetic microorganism comprises *Corynebacterium glutamicum* that has been transformed with the synthetic polynucleotide and the synthetic microorganism has improved growth on methane or ethane or consumes methane or ethane as a sole carbon source or as a major carbon source as compared to a microorganism that has not been transformed with the monooxygenase synthetic polynucleotide. In an embodiment, the synthetic microorganism comprises *Corynebacterium glutamicum* that has been transformed with the monooxygenase synthetic polynucleotide, the monooxygenase substrate comprises ethane and the chemical comprises ethanol. In an embodiment, the synthetic microorganism comprises *Corynebacterium glutamicum* that has been transformed with the monooxygenase synthetic polynucleotide, the monooxygenase substrate comprises methane and the chemical comprises methanol. In an embodiment, the synthetic microorganism comprises *Corynebacterium glutamicum* that has been transformed with the monooxygenase synthetic polynucleotide, the monooxygenase substrate comprises naphthalene and the chemical comprises 1-naphthol. In an embodiment, the synthetic microorganism comprises *Corynebacterium glutamicum* that has been transformed with the monooxygenase synthetic polynucleotide, the monooxygenase substrate comprises ethane and the chemical comprises an amino acid, such as glutamate, lysine, or methionine.

In an embodiment, the microorganism comprises *Corynebacterium glutamicum* and the synthetic microorganism is *Corynebacterium glutamicum* and the monooxygenase synthetic polynucleotide encodes for a soluble diiron monooxygenase enzyme which encodes a polypeptide which is at least 60%, preferably about 65%, preferably about 70%, preferably about 75%, preferably about 80%, preferably about 85%, preferably about 90% or preferably about 95% identical to the amino acid sequences set forth in SEQ ID NO: 8 and SEQ ID NO: 10 and SEQ ID NO: 12 and SEQ ID NO: 14 and SEQ ID NO: 59 and SEQ ID NO: 61. In an embodiment, the microorganism comprises *Corynebacterium glutamicum* and the synthetic microorganism is *Corynebacterium glutamicum* and the monooxygenase synthetic polynucleotide encodes for a soluble diiron monooxygenase enzyme which encodes a polypeptide that has the amino acid sequences set forth in SEQ ID NO: 8 and SEQ ID NO: 10 and SEQ ID NO: 12 and SEQ ID NO: 14 and SEQ ID NO: 59 and SEQ ID NO: 61 and the at least one protein folding chaperone has the amino acid sequences set forth in SEQ ID NO: 63 and SEQ ID NO: 65 and SEQ ID NO: 67 and SEQ ID NO: 69.

In an embodiment, synthetic polynucleotides encode enzymes selected from the group consisting of methanol dehydrogenase (EC 1.1.1.244 or 1.1.99.37 or 1.1.2.7), alcohol dehydrogenase (EC 1.1.1.1 or 1.1.1.2 or 1.1.2.8 or 1.1.3.13), aldehyde dehydrogenase (EC 1.2.1.3), acetaldehyde dehydrogenase (EC 1.2.1.10), acetyl-CoA synthetase (EC 6.2.1.1), isocitrate lyase (EC 4.1.3.1), malate synthase (EC 2.3.3.9), isocitrate dehydrogenase kinase/phosphatase (EC 2.7.11.5, EC 3.1.3). In an embodiment, the dehydrogenase enzyme or enzymes can be any one or more of methanol dehydrogenase (EC 1.1.1.244 or 1.1.99.37 or 1.1.2.7), alcohol dehydrogenase (EC 1.1.1.1 or 1.1.1.2 or 1.1.2.8 or 1.1.3.13), aldehyde dehydrogenase (EC 1.2.1.3), and/or acetaldehyde dehydrogenase (EC 1.2.1.10).

In an embodiment, the microorganism comprises *Pichia pastoris*. In an embodiment, the synthetic microorganism comprises *Pichia pastoris* and the monooxygenase synthetic polynucleotide encodes for a soluble diiron monooxygenase enzyme. In an embodiment, the soluble diiron monooxygenase enzyme comprises a methane monooxygenase, an ethane monooxygenase or a toluene-4-monooxygenase. In an embodiment, the synthetic microorganism comprises *Pichia pastoris* that has been transformed with the monooxygenase synthetic polynucleotide and the synthetic microorganism has improved growth on methane, ethane or naphthalene or consumes methane, ethane or naphthalene as a sole carbon source or as a major carbon source as compared to a microorganism that has not been transformed with the monooxygenase synthetic polynucleotide. In an embodiment, the synthetic microorganism comprises *Pichia pastoris* that has been transformed with the monooxygenase synthetic polynucleotide incorporating a monooxygenase from *Methylocystis* sp. LW5 and/or *Solimonas aquatica*, synthetic polynucleotide encoding groES and groEL chaperonin subunits, the monooxygenase substrate comprises methane and the chemical comprises methanol. In an embodiment, there are two plasmids involved in the *Pichia pastoris* transformation. In an embodiment, the synthetic microorganism comprises *Pichia pastoris* that has been transformed with the monooxygenase synthetic polynucleotide, the monooxygenase substrate comprises ethane and the chemical comprises ethanol. In an embodiment, the synthetic microorganism comprises *Pichia pastoris* that has been transformed with the monooxygenase synthetic polynucleotide, the monooxygenase substrate comprises ethane and the chemical comprises malate. In an embodiment, the synthetic microorganism comprises *Pichia pastoris* that has been transformed with an additional synthetic polynucleotide encoding the PYC2, MDH3(□SKL) and MAE1 genes, the monooxygenase substrate comprises ethane and the chemical comprises malate. In an embodiment, the synthetic microorganism comprises *Pichia pastoris* that has been transformed with the monooxygenase synthetic polynucleotide, the araBAD gene has been deleted, the substrate comprises methane and the chemical comprises methanol. In an embodiment, the synthetic microorganism comprises *Pichia pastoris* that has been transformed with the monooxygenase synthetic polynucleotide, the monooxygenase substrate is naphthalene and the chemical is 1-naphthol. In an embodiment, the monooxygenase is toluene-4-monooxygenase from *Pseudomonas mendocina* KR1, the monooxygenase substrate comprises naphthalene and the chemical is 1-naphthol. In an embodiment for any disclosure herein, monooxygenase(s) and/or protein folding chaperones are each selectively, completely or in particular combinations chosen and combined to improve overall monooxygenase activity. In an embodiment for any disclosure provided herein, the monooxygenase and/or protein folding chaperones are any proteins homologous enough to be suitable for the present disclosure and may be utilized in any amount and combination which would be suitable to carry out the claimed invention.

In an embodiment, the microorganism comprises *Pichia pastoris* and the synthetic microorganism is *Pichia pastoris* and the monooxygenase synthetic polynucleotide encodes for a soluble diiron monooxygenase enzyme which encodes a polypeptide which is at least 60%, preferably about 65%, preferably about 70%, preferably about 75%, preferably about 80%, preferably about 85%, preferably about 90% or preferably about 95% identical to the amino acid sequences set forth in SEQ ID NO: 144 and SEQ ID NO: 146 and SEQ ID NO: 148 and SEQ ID NO: 150 and SEQ ID NO: 152 and SEQ ID NO: 154. In an embodiment, the microorganism comprises *Pichia pastoris* and the synthetic microorganism is *Pichia pastoris* and the monooxygenase synthetic polynucleotide encodes for a soluble diiron monooxygenase enzyme which encodes a polypeptide that has the amino acid sequences set forth in SEQ ID NO: 144 and SEQ ID NO: 146 and SEQ ID NO: 148 and SEQ ID NO: 150 and SEQ ID NO: 152 and SEQ ID NO: 154 and the at least one protein folding chaperone has the amino acid sequences set forth in SEQ ID NO: 120 and SEQ ID NO: 122.

In a preferred embodiment, a microorganism is disclosed that comprises any one of the synthetic polynucleotides set forth herein. In an embodiment, the synthetic polynucleotide is a monooxygenase synthetic polynucleotide and/or dehydrogenase synthetic polynucleotide that comprises one or more of plasmids pBZ13 (SEQ ID NO: 15), pBZ15 (SEQ ID NO: 16), pBZ21 (SEQ ID NO: 17), pBZ23 (SEQ ID NO: 18), pBZ4 (SEQ ID NO: 19), pDG5 (SEQ ID NO: 21), pDG6 (SEQ ID NO: 22), pLC100 (SEQ ID NO: 23), pLC12 (SEQ ID NO: 24), pLC37 (SEQ ID NO: 25), pLC39 (SEQ ID NO: 26), pLC99 (SEQ ID NO: 27), pNH100 (SEQ ID NO: 28), pNH104 (SEQ ID NO: 29), pNH132 (SEQ ID NO: 30), pNH157 (SEQ ID NO: 31), pNH158 (SEQ ID NO: 32), pNH160 (SEQ ID NO: 33), pNH166 (SEQ ID NO: 34), pNH167 (SEQ ID NO: 35), pNH172 (SEQ ID NO: 36), pNH173 (SEQ ID NO: 37), pNH177 (SEQ ID NO: 38), pNH178 (SEQ ID NO: 39), pNH180 (SEQ ID NO: 40), pNH181 (SEQ ID NO: 41), pNH185 (SEQ ID NO: 42), pNH187 (SEQ ID NO: 43), pNH188 (SEQ ID NO: 44), pNH225 (SEQ ID NO: 45) and/or pNH238 (SEQ ID NO: 46) or any other synthetic polynucleotide or synthetic polypeptide disclosed herein. In a preferred embodiment, the microorganism is *Escherichia coli* that has been transformed with plasmids pBZ15 (SEQ ID NO: 16) and pNH225 (SEQ ID NO: 45).

In an embodiment for any disclosure provided herein, the microorganism is *Bacillus methanolicus*. In an embodiment for any disclosure provided herein, the microorganism is *Saccharomyces cerevisiae*.

Any of the embodiments provided herein may be carried out in a monoculture or carried out in a co-culture. In an embodiment, a methane assimilation pathway is incorporated into a heterologous host. In an embodiment, a methanol assimilation pathway is incorporated into a heterologous host.

A fourth aspect of the invention is drawn to a method for producing a chemical, comprising culturing any of the synthetic microorganisms provided herein under suitable culture conditions and for a sufficient period of time to produce the chemical. In an embodiment, the suitable culture conditions comprise a culture media containing at least one of methane, methanol, ethane, ethanol, propane, butane, or naphthalene as a sole carbon source or as a major carbon source. In an embodiment, the synthetic microorganism is cultured under conditions such that the synthetic microorganism produces a chemical that is converted into a second chemical by a second microorganism or a second synthetic microorganism.

BRIEF DESCRIPTION OF THE DRAWINGS

FIG. 18 shows the multiple sequence alignment between three monooxygenase subunits: the prm1a subunit of the propane monooxygenase (in pNH100 (SEQ ID NO: 28), from *Pseudonocardia* TY-7), the mmoX subunit of the ethane monooxygenase (in pNH160 (SEQ ID NO: 33), from *Solimonas aquatica*), and the mmoX subunits of the methane monooxygenase (in pDG5 (SEQ ID NO: 21), from *Methylococcus capsulatus* (Bath)). Stars beneath the sequences indicate positions at which the three sequences have a strictly conserved amino acid residue.

DETAILED DESCRIPTION OF THE INVENTION

Figure 1:
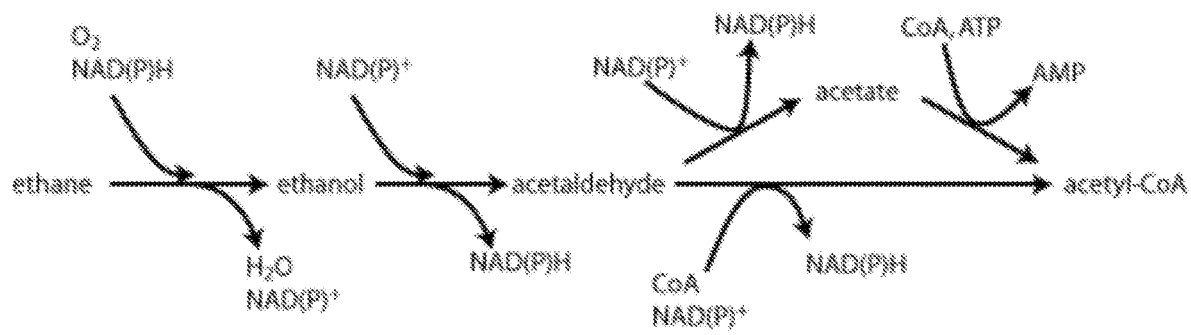
FIG. 1 shows two representative pathways from ethane to acetyl-CoA. Many enzymes or enzyme classes are known which catalyze each of these reaction steps. Depending on the exact enzymes present in a particular strain, the pathway may proceed via acetate or just directly from acetaldehyde to acetyl-CoA. Acetyl-CoA is a major node of central metabolism from which other key metabolites are built.

The disclosure provides synthetic polypeptides and proteins. The disclosure also provides microorganisms engineered to functionally express a monooxygenase enzyme that converts a wide range of organic substrates into an even broader range of products. The disclosure also provides microorganisms engineered to consume molecules containing carbon, such as alkane or molecules such as methane or methanol, ethane or ethanol. The invention also provides microorganisms engineered to convert methane and/or methanol or ethane and/or ethanol into industrial products.

Compositions and methods comprising using said microorganisms to produce chemicals are further provided. The methods provide for superior low-cost production as compared to existing sugar-consuming fermentation.

Unless defined otherwise, all technical and scientific terms used herein have the meaning commonly understood by one of ordinary skill in the art to which this invention belongs. Practitioners are particularly directed to (M R Green and J Sambrook, eds, Molecular Cloning: A Laboratory Manual, 4th ed., Cold Spring Harbor Laboratory Press, 2012), (F M Ausubel, Current Protocols in Molecular Biology (Supplement 99), John Wiley & Sons, New York, 2012), and (Bornscheuer, U. and R. J. Kazlauskas, *Curr Protoc Protein Sci*, 2011). Standard methods also appear in (Bindereif, Schön, & Westhof, Handbook of RNA Biochemistry, Wiley-VCH, Weinheim, Germany, 2005) which describes detailed methods for RNA manipulation and analysis, and (S L Beaucage et al., *Curr Protoc Nucleic Acid Chem*, 2009) and (A Y Keel et al., *Methods Enzymol* 469:3-25, 2009) which describe methods of chemical synthesis and purification of RNA, and are incorporated herein by reference. Examples of appropriate molecular techniques for generating nucleic acids, and instructions sufficient to direct persons of skill through many cloning exercises are found in (M R Green et al., Guide to Molecular Cloning Techniques, Methods in Enzymology, Volume 152 Academic Press, Inc., San Diego, Calif., 1987); and (PCR Protocols: A Guide to Methods and Applications, Academic Press, San Diego, Calif., 1990), which are incorporated by reference herein.

As used herein, the terms "accessory protein" and "helper protein" are intended to mean proteins that enable the function of a separate enzyme, collection of enzymes, enzyme complex made of more than one protein, or non-enzymatic protein. One example of the function of an accessory or helper protein is a protein that is known to aid in folding of other proteins (so called "protein folding chaperones" or "chaperonins"). Another example is a protein that modifies another protein, including post-translational modifications such as acetylation, methylation, acylation, farnesylation, etc., as well as the reverse reactions de-acetylation, de-methylation, etc., as well as removing a fraction of a protein. Other examples are proteins that aid an enzyme or enzyme complex in correctly assembling a prosthetic group, or loading a metal center, or enabling the enzyme or complex to become localized to the proper physical location in the cell, or enabling the transfer of electrons or other chemical groups to the enzyme. In some cases, accessory proteins enable the function of an enzyme, even though the exact mechanism of action is not yet known.

As used herein, the term "biomass" is intended to mean the collection of biological matter, made up of cells, that results from the culturing process of a microorganism under suitable conditions for the growth of that organism in culture. In some cases, the biomass includes simply the cells and their contents and in some cases, the biomass includes additionally any macromolecules, such as proteins, that are secreted into the culture, outside the boundary of the cell membrane.

As used herein, the term "carbon source" is intended to mean a raw material input to an industrial process that contains carbon atoms that can be used by the microorganisms in a culture. For example, industrial cultures of microorganisms may use glucose as a source of carbon atoms. As provided herein, in addition to typical carbon sources such as sugars and amino acids, the carbon source can additionally be methane, methanol, ethane, ethanol, or any of the compounds in Column A of Table 1. In some cases, a culture is grown in a medium containing a single usable compound that contains carbon atoms. As carbon is an element that is essential for life, the culture must have, in this example, metabolic pathways for converting the single compound containing carbon atoms into many other biological molecules necessary for the organism's survival.

As used herein, "sole carbon source" is intended to mean suitable conditions comprising a culture media containing either methane, methanol, ethane, ethanol, or any of the compounds in Column A of Table 1 as a carbon source such that, as a fraction of the total usable carbon atoms in the media, those compounds cited above, respectively, represent about 100% of the total usable carbon atoms in the media.

As used herein, "major carbon source" is intended to mean that where the suitable conditions comprise a culture media containing methane, methanol, ethane, or ethanol, or any of the compounds in Column A of Table 1 as a carbon source as a fraction of the total carbon atoms in the media, those compounds cited above represent, respectively, at least about 10% or more of the total usable carbon atoms in the media, about 20% or more of the total usable carbon atoms in the media, about 30% or more of the total usable carbon atoms in the media, about 40% or more of the total usable carbon atoms in the media, about 50% or more of the total usable carbon atoms in the media, about 60% or more of the total usable carbon atoms in the media, about 70% or more of the total usable carbon atoms in the media, about 80% or more of the total usable carbon atoms in the media or about 90% or more of the total usable carbon atoms in the media.

As used herein, the term "chemical" is broadly meant to include any substance used in or resulting from a reaction involving changes to atoms or molecules, especially one derived according to any of the processes set forth herein. As such, a chemical is intended to mean a substance obtained by a chemical process or a substance having a chemical effect. Examples of chemicals contemplated by the invention, without limitation, are dicarboxylic acid, malic acid, fumaric acid, succinic acid, malic acid salt, fumaric acid salt, succinic acid salt, L-malic acid, D-malic acid, maleic acid, lactic acid, adipic acid, 1,3-propanediol, 2,3-butanediol, 1,4-butanediol, butadiene, fatty acid derivatives, fatty alcohols, fatty acids, fatty acid esters, fatty acid methyl esters, fatty acid ethyl esters, branched fatty acids, branched fatty acid derivatives, omega-3 fatty acids, isoprenoids, isoprene, farnesene, farnesenes, squalene, squalane, carotenoids, any or all of the amino acids, alanine, arginine, asparagine, aspartic acid, cysteine, glutamic acid, monosodium glutamate, glutamine, glycine, histidine, isoleucine, leucine, lysine, methionine, phenylalanine, threonine, tryptophan, valine, ornithine, proline, selenocysteine, serine, tyrosine, ethanol, propanol, 1-butanol, 2-butanol, isobutanol (2-methylpropan-1-ol), alcohols, alkanes, alkenes, olefins, animal feed additives, mixtures of amino acids, and proteins. Other examples of chemicals include, but are not limited to, ethanol, propanol, isopropanol, butanol, fatty alcohols, fatty acid esters, ethyl esters, wax esters; hydrocarbons and alkanes such as propane, octane, diesel, Jet Propellant 8 (JP8); terephthalate, 1,3-propanediol, 1,4-butanediol, acrylate, adipic acid, ε-caprolactone, isoprene, caprolactam, polyols, Polyhydroxyalkanoates (PHA), poly-beta-hydroxybutyrate (PHB), rubber, and polymers made from terephthalate, 1,3-propanediol, 1,4-butanediol, acrylate, adipic acid, ε-caprolactone, isoprene, caprolactam; commodity chemicals such as lactate, docosahexaenoic acid (DHA), 3-hydroxypropionate, γ-valerolactone, lysine, serine, aspartate, aspartic acid, sorbitol, ascorbate, ascorbic acid, isopentenol, lanosterol, omega-3 DHA, lycopene, itaconate, 1,3-butadiene, ethylene, propylene, succinate, citrate, citric acid, glutamate, malate, 3-hydroxypropionic acid (HPA), lactic acid, THF, gamma butyrolactone, pyrrolidones, hydroxybutyrate, glutamic acid, levulinic acid, acrylic acid, malonic acid; specialty chemicals such as carotenoids, isoprenoids, itaconic acid; pharmaceuticals and pharmaceutical intermediates such as 7-aminodeacetoxycephalosporanic acid (7-ADCA)/cephalosporin, erythromycin, polyketides, statins, paclitaxel, docetaxel, terpenes, peptides, steroids, omega fatty acids and other such suitable products of interest. Such products are useful in the context of biofuels, industrial and specialty chemicals, as intermediates used to make additional products, such as nutritional supplements, nutraceuticals, polymers, paraffin replacements, personal care products and pharmaceuticals. Other examples of chemicals include, without limitation, all compounds that can be produced with the methods set forth herein. Such compounds are intended to include all molecules that can be constructed with the methods set forth herein including, for example without limitation, all organic and inorganic molecules that can be made with the methods set forth herein. The term chemical is intended to include natural and non-natural compounds. Examples of natural molecules include, but are not limited to, amino acids, nucleic acids, nucleotides and polynucleotides and all related biological molecules. Non-natural compounds include, but are not limited to, amino acids and nucleotides that are modified in a way differently than they are normally modified in biological systems, and compounds not normally found in nature.

As used herein, the term "coding region" or "coding sequences" are intended to mean DNA or RNA that encodes a region of, for example, but not limited to, polypeptides (i.e. proteins) using the genetic code. A coding region is often bounded at the 5' end by a start codon and nearer the 3' end with a stop codon. The start and stop codons do necessarily have to be at the beginning and end, respectively, of the coding region.

As used herein, the term "culturing" is intended to mean the growth or maintenance of microorganisms under laboratory or industrial conditions. The culturing of microorganisms is a standard practice in the field of microbiology. Microorganisms can be cultured using liquid or solid media as a source of nutrients for the microorganisms. In addition, some microorganisms can be cultured in defined media, in which the liquid or solid media are generated by preparation using purified chemical components. The composition of the culture media can be adjusted to suit the microorganism or the industrial purpose for the culture.

As used herein, the term "endogenous polynucleotides" is intended to mean polynucleotides derived from naturally occurring polynucleotides in a given organism. The term "endogenous" refers to a referenced molecule or activity that is present in the host. Similarly, the term when used in reference to expression of an encoding nucleic acid or polynucleotide it refers to expression of the encoding nucleic acid or polynucleotide contained within the microbial organism.

As used herein, the term "exogenous polynucleotides" is intended to mean polynucleotides that are not derived from naturally occurring polynucleotides in a given organism. Exogenous polynucleotides may be derived from polynucleotides present in a different organism. The exogenous polynucleotides can be introduced into the organism by introduction of an encoding nucleic acid into the host genetic material such as by integration into a host chromosome or as non-chromosomal genetic material such as a plasmid. Therefore, the term as it is used in reference to expression of an encoding nucleic acid refers to introduction of the encoding nucleic acid in an expressible form into the microbial organism. When used in reference to a biosynthetic activity, the term refers to an activity that is introduced into the host reference organism. The source can be, for example, a homologous or heterologous encoding nucleic acid that expresses the referenced activity following introduction into the host microbial organism. The term "heterologous" refers to a molecule or activity derived from a source other than the referenced species whereas "homologous" refers to a molecule or activity derived from the host microbial organism. Accordingly, exogenous expression of an encoding nucleic acid of the invention can utilize either or both a heterologous or homologous encoding nucleic acid. As set forth in the invention a nucleic acid need not include all of its relevant or even complete coding regions on a single polymer and the invention provided herein contemplates having complete or partial coding regions on different polymers.

As used herein, the term "enzyme" is intended to refer to molecules that accelerate or catalyze chemical reactions. Almost all metabolic processes in the cell need enzymes in order to occur at rates fast enough to sustain life. Some of the enzymes useful in the invention are, without limitation, methanol dehydrogenase (EC 1.1.1.244 or 1.1.99.37 or 1.1.2.7), alcohol dehydrogenase (EC 1.1.1.1 or 1.1.1.2 or 1.1.2.8 or 1.1.3.13), aldehyde dehydrogenase (EC 1.2.1.3), acetaldehyde dehydrogenase (EC 1.2.1.10), acetyl-CoA synthetase (EC 6.2.1.1), isocitrate lyase (EC 4.1.3.1), malate synthase (EC 2.3.3.9), isocitrate dehydrogenase kinase/phosphatase (EC 3.1.3.-), soluble methane monooxygenase (EC 1.14.13.25) and particulate methane monooxygenase (EC 1.14.18.3).

As used herein, the term "enzyme specificity" or "specificity of an enzyme" is intended to mean the degree to which an enzyme is able to catalyze a chemical reaction on more than one substrate molecule. An enzyme that can catalyze a reaction on exactly one molecular substrate, but is unable to catalyze a reaction on any other substrate, is said to have very high specificity for its substrate. An enzyme that can catalyze chemical reactions on many substrates is said to have low specificity. In some cases, the specificity of an enzyme is described relative to one or more defined substrates. With respect to the invention described herein, the specificity of a monooxygenase for methane (as the substrate) can be compared to that of another monooxygenase for methane by comparing the relative activities of the monooxygenases for methane against their relative activities against other substrates, such as ethane. In some cases, mutations to a monooxygenase can shift the enzyme specificity from preferring methane (i.e. having a higher activity for methane over ethane) to preferring ethane (i.e. having a higher activity for ethane over methane).

As used herein, the terms "ethanol-consuming organism", "ethylotroph", "ethylotrophic microorganism", "ethylotrophic organism", and "ethylotrophic" are intended to mean any organism that is able to convert ethanol (i.e. "ethyl alcohol", CH3OH) into a chemical or into biomass or into molecules that the organism can use in its metabolic pathways which generate energy or reducing equivalents so that the organism can grow using ethanol as a sole carbon source or major carbon source and/or energy source. For example, some naturally-occurring microorganisms are known to consume ethanol by converting it first into acetaldehyde, and then subsequently converting the acetaldehyde into acetate. Acetate is often converted into acetyl-CoA, a central node of metabolism common to all organisms. Some microorganisms convert acetaldehyde directly into acetyl-CoA in a single step. Other pathways that enable organisms to assimilate ethanol into metabolism are also possible and this example is not meant to limit the invention to the above-mentioned assimilation pathway.

As used herein, the terms "ethanotroph", "ethane-consuming organism", "ethanotrophic organism", "ethanotrophic microorganism", and "ethanotrophic" are intended to mean a microorganism that can consume ethane as its major carbon source and/or as its sole energy and/or sole carbon source. In contrast, a "non-ethanotrophic microorganism" is one that is incapable of survival on ethane as a sole carbon source or major carbon source.

As used herein, the term "methanotroph" is intended to mean an organism that is capable of growth using methane as the sole or major carbon source.

As used herein, the term "synthetic ethylotroph" is intended to mean a non-ethanol-consuming microorganism that has been modified to be able to consume ethanol as its sole energy and/or sole carbon source and/or major carbon source. Some ethylotrophs are naturally occurring, while others, described here in this invention, are synthetic. Synthetic ethylotrophs are organisms that are capable of surviving on ethanol as a sole carbon source or major carbon source due to the addition of a pathway that allows the assimilation of ethanol. Modification may be a genetic modification such as one or more mutations to the microorganisms' nucleic acids, the introduction of an episomal plasmid, and/or the introduction of exogenous polynucleotides.

As used herein, the term "synthetic ethanotroph" is intended to mean a non-ethane consuming microorganism that has been modified to be able to consume ethane as its sole energy and/or sole carbon source and/or major carbon source. Some ethanotrophs are naturally occurring, while others, described herein, are synthetic. Synthetic ethanotrophs are organisms that are capable of surviving on ethane as a sole carbon source or major carbon source due to the addition of a pathway that allows the assimilation of ethane. Modification may be a genetic modification such as one or more mutations to the microorganisms' nucleic acids, the introduction of an episomal plasmid, and/or the introduction of exogenous polynucleotides.

As used herein, the terms "ethanol assimilation pathway" and "ethanol utilization pathway" are intended to mean at least one enzyme, or a group or set of enzymes, that enable an organism to convert ethanol into metabolites that the organism can use as a source of mass (carbon, oxygen and hydrogen atoms) and energy.

As used herein, the term "improved growth" is intended to mean a situation in which a microbial strain has been modified in some way, usually through genetic modification, so that, under the prescribed conditions and relative to the original strain, the modified strain grows at a faster rate or achieves a higher density of cells. A direct comparison of two strains can be made by growing the strains under identical conditions and measuring the optical density (e.g. absorbance at 600 nm, "OD600") or doubling rate at various times in the cell growth. One strain will demonstrate improved growth, relative to the other strain, if it is quantitatively growing faster (i.e. doubling more often) or to a measurably higher cell density. A quantitative measure at each time point, such as the ratio of the OD600 values of the two strains or the ratio of the doubling rates, can be used to identify and track strains with improved growth.

As used herein, the terms "microbe", "microbial," "microbial organism" or "microorganism" are intended to mean any organism that exists as a microscopic cell that is included within the domains of archaea, bacteria or eukarya. Therefore, the term is intended to encompass prokaryotic or eukaryotic cells or organisms having a microscopic size and includes bacteria, archaea and eubacteria of all species as well as eukaryotic microorganisms such as yeast and fungi. The term also includes cell cultures of any species that can be cultured for the production of a biochemical.

As used herein, the term "mutation" is intended to mean a change from one nucleotide to another in a DNA sequence or in a polynucleotide or a change from one amino acid to another in a protein sequence or in a polypeptide.

As used herein, the term "naturally occurring" is intended to mean normally found in nature.

As used herein, the term "non-naturally occurring" when used in reference to a microbial organism or microorganism of the invention is intended to mean that the microbial organism has at least one genetic alteration or addition not normally found in a naturally occurring strain of the referenced species, including wild-type strains of the referenced species. Genetic alterations include, for example, modifications introducing expressible nucleic acids encoding metabolic polypeptides, other nucleic acid additions, nucleic acid deletions, and/or other functional disruption of the microbial genetic material. Such modifications include, for example, coding regions and functional fragments thereof, for heterologous, homologous or both heterologous and homologous polypeptides for the referenced species. Additional modifications include, for example, non-coding regulatory regions in which the modifications alter expression of a gene or operon. Exemplary metabolic polypeptides include enzymes capable of oxidizing hydrocarbons, such as alkanes and aromatic compounds or enzymes within a methanol-consuming or methane-consuming pathway or enzymes within an ethanol consuming or ethane-consuming pathway.

As used herein, the term "single-cell protein" is intended to mean a source of mixed protein extracted from pure or mixed cultures of microorganisms. Single-cell protein is used as a substitute for protein-rich foods in human and animal feeds.

As used herein, the term "soluble diiron monooxygenase" is intended to mean the class of enzymes and enzyme complexes characterized by a catalytic core of two iron atoms and the ability to utilize molecular oxygen ($O_2$) to catalyze hydroxylation or epoxidation of hydrocarbon bonds. These enzymes typically require NADH or NADPH as an electron donor. The soluble diiron monooxygenases (SDIMOs) are usually composed of three or four components: a hydroxylase (itself composed of multiple subunits), an oxidoreductase subunit, a coupling protein, and sometimes a ferredoxin protein. The class contains at least enzymes belonging to the subclasses: soluble methane monooxygenases, phenol hydroxylases, toluene monooxygenases, and alkene monooxygenases (Leahy et al., *Evolution of the Soluble Diiron Monoxygenases*, FEMS Microbiology Reviews, Vol. 27, p. 449-479, 2003). Despite their different names, each SDIMO may be active against a range of substrates. For example, the soluble methane monooxygenase (sMMO) has been shown to oxidize dozens of different hydrocarbon substrates.

As used herein, the term "methane monooxygenase enzyme" is intended to mean the class of enzymes and enzyme complexes capable of oxidizing a carbon-hydrogen bond of the methane molecule to result in a molecule of methanol. Naturally occurring methane-consuming microorganisms have evolved at least two classes of methane monooxygenase enzymes: soluble and particulate. Any enzyme or enzyme complex of these categories, any mutated enzyme or complex, or any researcher-designed enzyme or enzyme complex that converts methane into methanol would be considered a methane monooxygenase enzyme. Many of these enzymes are known to also oxidize a wide range of substrates, such as methane to methanol or ethane into ethanol, and thus, are relevant for the purpose of this invention.

As used herein, the term "ethane monooxygenase enzyme" is intended to mean the class of enzymes and enzyme complexes capable of oxidizing a carbon-hydrogen bond of the ethane molecule to result in a molecule of ethanol. Any enzyme or enzyme complex of these categories, any mutated enzyme or complex, or any researcher-designed enzyme or enzyme complex that converts ethane into ethanol would be considered an ethane monooxygenase enzyme. Many of these enzymes are known to also oxidize a wide range of substrates, such as methane to methanol or ethane into ethanol or propane to propanol, and thus, are relevant for the purpose of this invention.

As used herein, the term "hybrid monooxygenase" or "hybrid SDIMO" is intended to mean an enzyme complex comprised of subunits from at least two different sources. Whereas a typical enzyme complex may be sourced from a single microorganism, it may be possible to swap in a particular subunit from a different microorganism and maintain catalytic activity. The source microorganisms may be closely related organisms, or not. If the subunits are somewhat homologous to each other, they may be interchangeable to some degree. This may lead to useful discoveries or enzyme properties. For example, the mmoX from one sMMO enzyme complex might be replaced from the mmoX from another, homologous sMMO enzyme.

As used herein, the term "dehydrogenase" is intended to mean an enzyme belonging to the group of oxidoreductases that oxidizes a substrate by a reduction reaction that removes one or more hydrogen atoms from a substrate to an electron acceptor. Acetaldehyde dehydrogenases are dehydrogenase enzymes which catalyze the conversion of acetaldehyde into acetic acid. Alcohol dehydrogenases are a group of dehydrogenase enzymes that occur in many organisms and facilitate the interconversion between alcohols and aldehydes or ketones with the reduction of nicotinamide adenine dinucleotide. As is relevant herein, alcohol dehydrogenase oxidizes methanol to formaldehyde and/or ethanol to acetaldehyde. Some enzymes, such as adhE from *E. coli*, can catalyze both the alcohol dehydrogenase and acetaldehyde dehydrogenase reactions.

As used herein, the term "pathway" is intended to mean a set of enzymes that catalyze the conversion of substrate chemical(s) into product chemical(s) using one or more enzymatic steps. Glycolysis is an example of a pathway in many living cells. In the context of this invention, a pathway may be a synthetic pathway (comprised of exogenous enzymes) or a partially synthetic pathway (comprised of both exogenous and endogenous enzymes).

As used herein, the term "percent identity", as it refers to a multi-subunit protein complex, is intended to mean the maximum value for the percent identity between any pairwise combination of amino acid sequences, calculated between all the subunits in one complex measured against all the subunits in the second complex. The percent identity between two subunits can be calculated using publicly available computational tools, such as BLASTp from NCBI.

The terms "polynucleotide", "oligonucleotide", "nucleotide sequence", and "nucleic acid sequence" are intended to mean one or more polymers of nucleic acids and include, but are not limited to, coding regions, which are transcribed or translated into a polypeptide or chaperone, appropriate regulatory or control sequences, controlling sequences, e.g., translational start and stop codons, promoter sequences, ribosome binding sites, polyadenylation signals, transcription factor binding sites, termination sequences, regulatory domains and enhancers, among others. A polynucleotide, as used herein, need not include all of its relevant or even complete coding regions on a single polymer and the invention provided herein contemplates having complete or partial coding region on different polymers.

As used herein, the term "complementary nucleotide" refers to a nucleotide in which, when conditions permit the annealing or hybridization of nucleic acid strands to a polynucleotide of interest, anneals or hybridizes to the polynucleotide of interest.

As used herein, the term "homolog" or "homologous" are used to describe a nucleotide or protein sequence or part of a nucleotide or protein sequence that has a high similarity or identity to a respective nucleotide protein sequence disclosed herein. Homology is often manifested by significant similarity in nucleotide or amino acid sequence and almost always manifested in three-dimensional structure. Different organisms may have proteins that are homologous and certain positions in the respective proteins may have an equivalent position in homologous proteins. Homology and equivalence and conserved residues among different organisms may be identified by using computer programs such as BLAST, ClustalW or ClustalX, among others. If a specific residue in an amino acid sequence is disclosed herein, the invention is also meant to encompass residues in homologous proteins in different species where the proteins are determined to be equivalent at that position in those different species.

As used herein, the term "promoter" is intended to mean a fragment of DNA that initiates the process of transcription of when it is functionally linked or operatively linked to one or more gene(s), coding region(s), or open reading frame(s). In some cases, a promoter is functionally linked to exactly one gene, while in other cases a promoter may be functionally linked to more than one gene.

As used herein, "functionally linked" or "operatively linked" shall refer to a relationship between at least two fragments of nucleic acid when they are placed into a functional disposition with respect to each other. For example, a promoter or enhancer is operatively linked to a coding sequence if it affects the transcription of the sequence or a ribosome binding site is operatively linked to a coding sequence if it is positioned so as to facilitate translation. Generally, "functionally linked" or "operatively linked" means that DNA sequences being linked are contiguous or in a dispositional relationship that makes one or the other functional. Sequences do not, however, have to be contiguous to be operatively linked or functionally linked.

As used herein, the terms "protein folding chaperone" and "folding chaperone" and "chaperone" are intended to mean one or more proteins that improve the folding of polypeptide (amino acid) chains into 3-dimensional structures. Protein folding chaperones help their substrates, namely other proteins, to become properly folded and often more highly soluble. Since most proteins must be folded in a particular shape to be functional, the expression of protein folding chaperones can assist in the proper assembly of certain enzymes in a cell and thereby can result in an increase in the enzymatic activity of the substrate proteins.

As used herein, the term "subunit" shall mean a protein molecule which assembles or coassembles with other protein molecules to form a protein complex, or enzyme. In the case of the current disclosure, for example, without limitation, a monooxygenase enzyme may be composed of one or more of the following subunits: mmoB, mmoC, mmoD, mmoX, mmoY and/or mmoZ. The disclosure is intended to include some or all of the subunits from any microorganism or combination of microorganisms, as determined by one skilled in the art.

As used herein, the term "suitable conditions" is intended to mean any set of culturing parameters that provide the microorganism with an environment that enables the culture to consume the available nutrients. In so doing, the microbiological culture may grow and/or produce chemicals or byproducts. Culturing parameters may include, but not be limited to, such features as the temperature of the culture media, the dissolved oxygen concentration, the dissolved carbon dioxide concentration, the rate of stirring of the liquid media, the pressure in the vessel, etc.

As used herein, the term "sufficient period of time" is intended to mean at least a minimum amount of time required to allow microorganisms in the culture to produce a chemical of interest. Beyond the minimum, a "sufficient period of time" encompasses any amount of time that enables the culture to produce the chemical to a desired level. An industrial-scale culture may require as little as 5 minutes to begin production of detectable amounts of a chemical and some cultures can be productive for several months.

As used herein, the term "synthetic" is intended to mean a molecule or microorganism, for example, without limitation, that has been manipulated into a form not normally found in nature. For example, a synthetic microorganism shall include, without limitation, a microorganism that has been manipulated to overexpress a polypeptide or transformed to include and/or express a synthetic polynucleotide of interest. A synthetic polynucleotide shall mean a polynucleotide that has been manipulated, for example by moving segments, introducing or rearranging segments or introducing a mutation. A synthetic polypeptide shall mean an amino acid sequence that has been manipulated.

As used herein, the term "transporter" is intended to mean a component of the cell that regulates the passage of a chemical, small molecule, or protein across a biological membrane.

As used herein, "variant" shall mean an amino acid sequence or a nucleotide sequence that has been modified wherein the resulting modified polypeptide and/or nucleotide sequence still has substantially the same function, performs its function in substantially the same way and/or achieves the same result. Variants of the polypeptides disclosed herein shall mean, for example without limitation, one or more differences or variations between the polypeptides disclosed herein and the polypeptide of interest.

Enzymes are useful catalysts for performing chemical reactions.

Chemistry is fundamentally about efficiently rearranging atoms from one molecule into another. Biological enzymes that can perform chemical reactions are useful tools for a range of applications, such as the fermentative production of chemicals, pharmaceutical manufacturing, and environmental bioremediation of toxic molecules. Some enzymes are capable of catalyzing reactions that are difficult (or expensive, or energy-intensive, or hazardous, or use environmentally unfavorable catalysts, etc.) for traditional bulk chemistry. A low-cost, low-energy, low-impact method of catalysis is a significant advance.

Carbon-hydrogen bonds are highly stable.

The bond between a carbon atom and a hydrogen atom in an organic compound is one of the most stable and difficult to break bonds. The bond is non-polar and has a bond dissociation energy around 100 kcal/mol, depending on the other atoms and bonds in its immediate surroundings.

Chemical methods for oxidizing carbon-hydrogen bonds are energy intensive and wasteful.

In order to combine organic compounds with each other, chemists have long sought an efficient technique for activating the carbon-hydrogen bond for a range of substrates, from simple alkanes such as methane, ethane and propane, up through aromatic compounds, like naphthalene. Some of these types of reactions can be done using halide chemistry, but those methods are wasteful, energy-intensive, and non-specific. Other chemical reactions on hydrocarbons, such as Fischer-Tropsch, are also very energy-intensive and must operate at high temperatures.

Nature has evolved monooxygenase enzyme complexes to oxidize organic compounds.

Hydrocarbons are rich in energy and microorganisms have evolved pathways to consume them as sources of carbon atoms and energy. Bacteria that can consume methane as a sole carbon source are called methanotrophs. A great deal of scientific research has focused on these bacteria and the pathways they use to assimilate methane. The enzyme complexes that activate methane belong to one of two classes: the particulate (membrane-bound) methane monooxygenase (pMMO) or the soluble methane monooxygenase (sMMO). Both enzymes oxidize methane to methanol. In the course of studying these complicated enzymes, researchers discovered that pMMO was capable of oxidizing some other short hydrocarbons (such as ethane, propane, butane, ethylene, propylene, etc.) while sMMO was capable of oxidizing a wide range of hydrocarbons. (Vazquez-Duhalt and Quintero-Ramirez, *Petroleum Biotechnology*, 2004).

Some microorganisms have been discovered that cannot consume methane, but instead can assimilate other hydrocarbons, such as ethane, propane, butane, and so on. Though there are some variations, enzymes active against short alkanes frequently appear evolutionarily related to the sMMO. Some researchers have thus classified them by their structure as soluble diiron monooxygenases (SDIMOs). Their structure is characterized by a hydroxylase unit (often composed of 2 or 3 polypeptide subunits), a reductase, and sometimes a ferredoxin and a helper protein.

Functional heterologous expression of monooxygenase enzymes in industrial hosts is an important tool for biotechnology.

The SDIMOs are an important enzyme class for biotechnology because they catalyze a difficult chemical reaction: the oxidation of a carbon-hydrogen bond or of a carbon-carbon double bond. Most industrially useful biotechnology processes are conducted in genetically tractable model organisms, such as *Escherichia coli, Corynebacterium glutamicum, Bacillus subtilis, Saccharomyces cerevisiae, Pichia pastoris*, and others. None of these organisms has enzymes for oxidizing short alkanes or many other hydrocarbons. The functional heterologous expression of an SDIMO in these organisms would enable a range of applications. In particular, the wide substrate acceptance range of SDIMOs will provide new connections for metabolic engineering of these valuable organisms. For example, the sMMO from methanotrophic bacteria has, so far, been shown to accept at least 50 unique substrates, which are summarized in Table 1. Given the wide range of substrates that have been found to be hydroxylated by this enzyme, it is likely that the list is incomplete. As additional substrates are tested, this list will likely grow and as such, Table 1 is not meant to be limiting, but instead exemplary of the many substrates of this class of enzymes.

| COLUMN A Substrate | COLUMN B Product(s) |
|---|---|
| methane | methanol |
| ethane | ethanol |
| propane | propan-1-ol; propan-2-ol |
| butane | butan-1-ol; butan-2-ol |
| pentane | pentan-1-ol; pentan-2-ol |
| hexane | hexan-1-ol; hexan-2-ol |
| heptane | heptan-1-ol; heptan-2-ol |
| octane | octan-1-ol; octan-2-ol |
| 2-methylpropane | 2-methylpropan-1-ol; 2-methylpropan-2-ol |
| 2,3-dimethylpentane | 3,4-dimethylpentan-2-ol |
| ethane | epoxyethane |
| propene (propylene) | 1,2-epoxypropane; propylene oxide |
| but-1-ene | 1,2-epoxybutane |
| cis-but-2-ene | cis-2,3-epoxybutane; cis-2-buten-1-ol, 2-butanone |
| trans-but-2-ene | trans-2,3-epoxybutane; trans-2-buten-1-ol |
| cyclohexane | cyclohexanol |
| methylene | 1-cyclohexane-1-methanol; |
| cyclohexane | methylenecyclohexane oxide; 4-hydroxymethylene cyclohexane |
| □-pinene | 6,6-dimethylbicyclo[3.1.1]hept-2-ene-2-methanol; □- pinene oxide |
| adamantane | 1-adamantol; 2-adamantol |
| cis-1,4-dimethylcyclohexane | 1-cis-4-dimethylcyclohexanol; 1-trans-4-dimethylcyclohexanol; cis-2,5-dimethylcyclohexanol |
| cis-1,3-dimethylcyclohexane | 3,5-dimethylcyclohexanol; 1-cis-3-dimethylcyclohexanol; 1-trans-3-dimethylcyclohexanol |
| trichloroethene | formate; CO; glyoxylate; dichloroacetate; chloral |
| vinyl chloride | |
| 1,1-dichloroethene | glycolate; dichloroacetaldehyde |
| trifluoroethylene | glyoxylate; difluoroacetate; fluoral |
| chlorotrifluoroethylene | oxalate |
| tribromoethylene | formate; bromal |
| benzene | phenol, cyclohexanol, hydroquinone |
| toluene | benzyl alcohol; 4-cresol |
| ethylbenzene | 1-phenylethanol; 3-ethylphenol; 4-ethylphenol; 4-hydroxyethylbenzene |
| styrene | styrene oxide; styrene epoxide |
| pyridine | pyridine N-oxide |
| naphthalene | 1-naphthol; 2-naphthol |
| biphenyl | 2-hydroxybiphenyl; 3-hydroxybiphenyl; 4-hydroxybiphenyl |
| 2-hydroxybiphenyl | dihydroxybiphenyls |
| 2-methylbiphenyl | ring and sidechain hydroxylated products |
| 2-chlorobiphenyl | hydroxychlorobiphenyls |
| 2-bromobiphenyl | hydroxybromobiphenyls; 2-hydroxybiphenyl |
| 2-iodobiphenyl | hydroxyiodobiphenyls; 2-hydroxybiphenyl |
| chloromethane | formaldehyde |
| dichloromethane | carbon monoxide |
| bromomethane | |
| nitromethane | |
| methanethiol | |
| methanol | |
| diethyl ether | ethanol; acetaldehyde |
| carbon monoxide | carbon dioxide |
| cyclohexene | epoxycyclohexane; 2-cyclohexen-1-ol |
| dimethyl ether | methanol; formaldehyde |
| difluoromethane | difluoromethanol |
| fluorobenzene | fluorophenol |
| fluoromethane | fluoromethanol |
| isopentane | 2-methylbutan-1-ol; 3-methylbutan-1-ol; 2-methylbutan-2-ol; 3-methylbutan-2-ol |
| methylamine | hydroxymethylamine |
| methylcyanide | hydroxymethylcyanide |
| nitrobenzene | nitrophenol |
| phenylalanine | tyrosine |
| xylene | xylenol |

Table 1. List of substrates and products that have been positively identified as being catalyzed by sMMO (Vazquez-Duhalt and Quintero-Ramirez, *Petroleum Biotechnology*, 2004; Green and Dalton, Substrate Specificity of Soluble Methane Monooxygenase, J. Biol. Chem., Vol. 264 No. 30, pp. 17698-17703, 1989; BRENDA online database http://www.brenda-enzymes.org/enzyme.php?ecno=1.14.13.25):

Monooxygenases will allow industrial biotechnology to use less expensive raw materials for the manufacture of many commercially available chemicals.

One particularly valuable application of SDIMO expression in industrial biotechnology is the utilization of low cost raw materials for the production of commodity and specialty chemicals. Recent advances in technologies for the extraction of natural gas have flooded the market with low-cost short gaseous alkanes. These gases (methane, ethane, etc.) could be used as a feedstock for a wide range of fermentation-derived chemicals. The functional expression of SDIMOs in industrial hosts, such as *E. coli* and yeast, provides a key catalytic step that will enable a complete pathway from the inexpensive feedstock (i.e. methane, ethane, etc.) into central metabolism, from which a myriad of industrial chemicals can be produced at lower cost. Another application may be the repurposing of low value fractions of petroleum. SDIMOs may be able to perform the difficult first step of adding a useful chemical handle onto the hydrocarbon that can be used by subsequent enzymes or can be passed to a chemical reactor or may be a product in itself.

Soluble methane monooxygenases and other SDIMOs are highly promiscuous enzymes that can catalyze many chemical reactions.

One of the most well-studied SDIMOs is the sMMO from *Methylococcus capsulatus* (Bath). Studies of sMMO in vitro have identified many key aspects of its structure, biochemical mechanism, and substrate specificity. Remarkably, this enzyme is able to hydroxylate a large number of substrates. As summarized in *Petroleum Biotechnology* by Vazquez-Duhalt and Quintero-Romero in 2004, sMMO is able to hydroxylate dozens of substrates into an even larger number of products, when assayed in vitro. Other SDIMOs have evolved different substrate specificities. For example, the butane monooxygenase of *Thauera butanivorans* is most active on butane, and maintains some activity against shorter alkanes. Another example is toluene-4-monooxygenase from *Pseudomonas mendocina* KR1. This enzyme is evolutionarily-related to sMMO, but has significantly higher activity against aromatic hydrocarbon substrates.

Heterologous expression of monooxygenase enzymes has been limited.

Several attempts over the last 25 years to express the complete sMMO in *E. coli*, primarily with the intention of easing the purification procedure of the enzyme, have been unsuccessful. Though proteins B and C have been purified from *E. coli* and shown to be functional (West et al., *Functional Expression in Escherichia coli of Proteins B and C from Soluble Methane Monooxygenase of Methylococcus capsulatus* (*Bath*), J. General Microbiology, Vol. 138, p. 1301-1307, 1992), the remaining subunits have been notoriously difficult to express (Lloyd et al., *Heterologous expression of soluble methane monooxygenase genes in methanotrophs containing on particulate methane monooxygenase*, Arch. Microbiol., Vol. 171, p. 364-370, 1999; Smith et al., *Improved system for protein engineering of the hydroxylase component of soluble methane monooxygenase*, Appl. Env. Micro., Vol. 68 No. 11, p. 5265-73, 2002; Nichol et al., *Controlling the activities of the diiron centre in bacterial monooxygenases: lessons from mutagenesis and biodiversity*, Eur. J. Inorg. Chem., p. 3419-31, 2015). In fact, researchers wishing to isolate the sMMO enzyme for in vitro or mechanistic studies have devised complicated methods to express mutants in the native host, in order to specifically circumvent the problematic expression of the functional enzyme in a heterologous host (Ali and Murrell, *Development and validation of promoter probe vectors for the study of methane monooxygenase gene expression in Methylococcus capsulatus Bath*, Microbiology, vol. 155, p. 761-71, 2009; Smith et al., *Improved system for protein engineering of the hydroxylase component of soluble methane monooxygenase*, Appl. Env. Micro., Vol. 68 No. 11, p. 5265-73, 2002; Nichol et al., *Controlling the activities of the diiron centre in bacterial monooxygenases: lessons from mutagenesis and biodiversity*, Eur. J. Inorg. Chem., p. 3419-31, 2015).

The invention described below is the first reported functional heterologous expression of the soluble methane monooxygenase in an industrially-relevant microorganism.

The examples below describe the first successful demonstration of the sMMO expressed in microorganisms that are commonly used in industrial biotechnology. The invention is drawn to the expression of an SDIMO enzyme in a heterologous host microorganism. In one embodiment, the host microorganism is at least one of *Escherichia coli, Bacillus subtilis, Bacillus methanolicus, Pseudomonas putida, Saccharomyces cerevisiae, Pichia pastoris, Pichia methanolica, Salmonella enterica, Corynebacterium glutamicum, Klebsiella oxytoca, Anaerobiospirillum succiniciproducens, Actinobacillus succinogenes, Mannheimia succiniciproducens, Rhizobium etli, Gluconobacter oxydans, Zymomonas mobilis, Lactococcus lactis, Lactobacillus plantarum, Streptomyces coelicolor, Clostridium acetobutylicum, Pseudomonas fluorescens, Schizosaccharomyces pombe, Kluyveromyces lactis, Kluyveromyces marxianus, Aspergillus terreus, Aspergillus niger*, and *Candida utilis*. In an embodiment, the microorganism is *Escherichia coli*. In an embodiment, the microorganism is *Pichia pastoris*. In an embodiment, the microorganism is *Saccharomyces cerevisiae*. In an embodiment, the microorganism is *Corynebacterium glutamicum*. In an embodiment, the microorganism is *Bacillus methanolicus*. In another embodiment, the SDIMO enzyme is more than about 80% homologous (at the amino acid sequence level) to the SDIMOs found in the microorganisms *Pseudomonas mendocina* KR1, *Methylosinus trichosporium* OB3b, *Methylomonas methanica, Methylococcus capsulatus* (Bath), *Methylocella silvestris, Methylocaldum* sp. 175, *Methyloferula stellata, Methylocystis* LW5, *Solimonas aquatica* (DSM 25927), *Methylovulum miyakonense, Mycobacterium chubuense* NBB4, *Mycobacterium smegmatis* mc2-155, *Thauera butanivorans, Pseudonocardia* TY-7, *Pseudonocardia autotrophica, Amycolatopsis methanolica, Rhodococcus ruber* IGEM 231, and *Conexibacter woesei*. In an embodiment, the SDIMO is a soluble methane monooxygenase. In an embodiment, the SDIMO is an ethane, propane, or butane monooxygenase. In an embodiment, the SDIMO is a soluble methane monooxygenase expressed in a microorganism that is at least one of *Escherichia coli, Saccharomyces cerevisiae, Pichia pastoris, Bacillus methanolicus*, and *Corynebacterium glutamicum*. In an embodiment, the SDIMO is neither the mimABCD from *Mycobacterium smegmatis* mc2-155 nor the toluene-4-monooxygenase from *Pseudomonas mendocina* KR1 expressed in the microorganism *Escherichia coli*. In an embodiment, the SDIMO is the sMMO from *Methylococcus capsulatus* (Bath) expressed in the microorganism *Escherichia coli*. In an embodiment, the SDIMO is expressed in the microorganism along with the expression of at least one protein that improves the folding or solubility of the SDIMO subunits or the SDIMO complex. In an embodiment, the SDIMO is a hybrid enzyme wherein each polypeptide subunit may not be derived from a single SDIMO enzyme complex from a single microorganism.

This is a major advance for biotechnology as it opens the door to additional metabolic engineering for the production of chemicals from inexpensive feedstocks in an environmentally-friendly manner.

Ethane is an Ideal Raw Material for Chemical Production

An ethane-consuming industrial microorganism may produce fuels and commodity chemicals that are impossible to profitably generate using sugar. Ethane is an ideal feedstock for fuel and chemical production due to its low cost, high energy density, abundance in the US, and year-round availability. On a per carbon basis, ethane is significantly cheaper than sugar. Ethane is a useful feedstock in the chemicals industry already, and thus, there is an established infrastructure and industrial experience with ethane as a feedstock.

Advantages of Ethane Over Methane as a Feedstock

Methane is an excellent feedstock, as well, for industrial fermentations, for many of the same reasons above. Recently, their cost has been approximately the same. However, there are significant advantages to ethane over methane, in many cases. First, ethane is assimilated into central metabolism at acetyl-CoA directly, whereas methane is assimilated through the pentose-phosphate pathway ultimately generating one glycolysis intermediate (e.g. DHAP) for each 3 methane molecules. Thus, some products that are made from DHAP, for example, may be more efficient to make from methane; however, many products are made through the acetyl-CoA node, and these would be perfect candidates for an ethane-fed fermentation. This also avoids the loss of a $CO_2$ molecule between pyruvate and acetyl-CoA, conserving carbon atoms and improving the carbon emissions profile of the fermentation. Second, it's more efficient for carbon to be assimilated in 2-carbon units, rather than 1-carbon units, since building carbon-carbon bonds is difficult and energy-intensive. Third, more of the standard microorganisms of industrial biotechnology already (without further modification) can consume ethanol aerobically, while only a subset of organisms, such as Pichia pastoris and the lesser-used Bacillus methanolicus, can consume methanol.

Advantages of Developing Synthetic Ethanotrophic Microorganisms

Several microorganisms have received the majority of study by microbiologists and metabolic engineers over the past few decades. These model organisms, Escherichia coli, Saccharomyces cerevisiae, Clostridium acetobutylicum, Corynebacterium glutamicum, Pichia pastoris, Bacillus subtilis, Psuedomonas putida, and Chlorella protothecoides, are the host cells that provide the most flexible, well-understood, genetically tractable starting points for further engineering. A range of tools and techniques has been developed to iteratively construct and evaluate modified derivatives of these strains. The invention of any new core functionality, such as the ability to consume ethane, in any of these strains is a significant achievement. A modular genetic component, or set of components, to consume ethane may be combined with existing engineered strains to produce a range of industrial products. Several of these strains are naturally capable of consuming ethanol as a sole or major carbon and energy source, as we have observed ourselves. Such microorganisms are already in industrial use as engineered biocatalysts, turning carbohydrates into a range of biological and chemical products. The ability to engineer these strains further to broaden their feedstock options to include ethane will be a valuable product in itself. Since ethane is one of the least-expensive carbon-based feedstocks, chemical producers, for instance, would prefer to feed ethane to their fermentations.

Pathways for Ethane Assimilation

Ethane can be utilized by some naturally occurring microorganisms as the sole carbon and energy source. So far, all known ethanotrophic microorganisms first oxidize the ethane to ethanol. The enzyme that performs this chemistry belongs to one of a few classes of monooxygenase enzymes (described herein). Thus, for most organisms (that can assimilate ethanol), the task of engineering ethane assimilation primarily (though not exclusively) focuses on achieving functional heterologous expression of at least one of the monooxygenase enzymes.

Enzymes that Transform Ethane

Under aerobic conditions, ethanotrophs fix ethane into central metabolism by first oxidizing ethane to ethanol, and then by converting ethanol into acetyl-CoA, via acetaldehyde. The biochemistry of the first step (ethane to ethanol) is carried out by one of a set of monooxygenase enzymes. Some utilize a soluble enzyme complex, while others utilize a membrane-bound "particulate" monooxygenase (N V Coleman et al., *Hydrocarbon monooxygenase in Mycobacterium: recombinant expression of a member of the ammonia monooxygenase superfamily*, 6 The ISME Journal 171-182, 2012). For natural methanotrophs, scientists have shown (J Green & H Dalton, *Substrate specificity of soluble methane monooxygenase. Mechanistic implications*, 264 Journal of Biological Chemistry 17698-17703, 1989) that their methane monooxygenase (MMO) enzymes will also oxidize ethane (in addition to methane). Meanwhile, some non-methanotrophic microorganisms are capable of growth on ethane, propane, and butane, but not methane (M C Redmond et al., *Identification of novel methane-, ethane-, and propane-oxidizing bacteria at marine hydrocarbon seeps by stable isotope probing*, 76 Applied and Environmental Microbiology 6412-6422, 2010). These two enzyme types are generally quite closely related by evolution, despite their differences in substrate specificity. Some such propane-oxidizing or butane-oxidizing bacteria have been discovered, such as *Mycobacterium smegmatis* mc2-155, *Gordonia* TY-7 and *Thauera butanivorans*. Yet another class of monooxygenases is the P450 enzymes. Some of these have been engineered using directed evolution to oxidize ethane, though the natural substrate specificity was quite different (F Xu et al., *The Heme Monooxygenase Cytochrome P450*, 4029-4032, 2005); (P Meinhold et al., *Direct Conversion of Ethane to Ethanol by Engineered Cytochrome*, 0017 1765-1768, 2005)

Prior Work Expressing Monooxygenases in *E. coli* and *S. cerevisiae*

There are no reports of successful ethane oxidation in vivo in the model organisms *E. coli* and *S. cerevisiae*. Though some of the MMO components have been expressed in *E. coli*, these components did not assemble into a functional MMO enzyme complex (C A West et al., *Functional expression in Escherichia coli of proteins B and C from soluble methane monooxygenase of Methylococcus capsulatus (Bath)*, 138 Journal of general microbiology 1301-1307, 1992). The heterologous expression of alkane monooxygenases with longer chain specificity has mostly failed, with a few exceptions in which the source organism is closely related to the expression host. A toluene 4-monooxygenase (T4MO) was reported to have been functionally expressed in *E. coli*. (K Canada et al., *Directed Evolution of Toluene ortho-Monooxygenase for Enhanced 1-Naphthol Synthesis and Chlorinated Ethene Degradation Directed Evolution of Toluene ortho-Monooxygenase for Enhanced 1-Naphthol Synthesis and Chlorinated Ethene Degradation*, 184 344-349, 2002). Toluene is a rather different substrate than ethane, but the genomic structure of the T4MO operon suggests evolutionary conservation between T4MO and sMMO, so it is worthy of note. A second interesting report of a monooxygenase expressed in a new host came from an experiment in which a pMMO enzyme was apparently expressed in *Rhodococcus erythropolis* in 2006 and functional at a very slow rate (Z Gou et al., *Functional expression of the particulate methane monooxygenase gene in recombinant Rhodococcus erythropolis*, 263 FEMS Microbiology Letters 136-141, 2006). *R. erythropolis* is a remarkable strain with a very wide range of endogenous monooxygenases (C de Carvalho, *The remarkable Rhodococcus erythropolis*, 715-726, 2005). No additional reports have confirmed this original publication. A phenol hydroxylase enzyme and its chaperonin was refactored and successfully expressed in *E. coli* (T Furuya et al., *Reconstitution of active mycobacterial binuclear iron monooxygenase complex in Escherichia coli*, 79 Applied and Environmental Microbiology 6033-6039, 2013). Despite all this work, no group has reported a standard industrial microorganism having been engineered to consume methane or ethane or to convert methane, ethane or ethanol into a commercial product.

Many Industrial Chemical Classes are Possible Commercial Products

Over the last few decades, several companies have successfully commercialized or developed microorganisms capable of producing industrial chemicals from sugar feedstocks. These projects would benefit from reduced feedstock costs, such as being able to use ethane instead of sugar. Products currently developed include, but are not limited to, malic acid, fumaric acid, succinic acid, malic acid salt, fumaric acid salt, succinic acid salt, L-malic acid, D-malic acid, maleic acid, lactic acid, adipic acid, 1,3-propanediol, 2,3-butanediol, 1,4-butanediol, butadiene, fatty acid derivatives, fatty alcohols, fatty acids, fatty acid esters, fatty acid methyl esters, fatty acid ethyl esters, branched fatty acids, branched fatty acid derivatives, omega-3 fatty acids, isoprenoids, farnesene, farnesene, squalene, squalane, carotenoids, amino acids, alanine, arginine, asparagine, aspartic acid, cysteine, glutamic acid, monosodium glutamate, glutamine, glycine, histidine, isoleucine, leucine, lysine, methionine, phenylalanine, threonine, tryptophan, valine, ornithine, proline, selenocysteine, serine, tyrosine, ethanol, propanol, 1-butanol, 2-butanol, isobutanol (2-methylpropan-1-ol), alcohols, alkanes, alkenes, olefins, animal feed additives, mixtures of amino acids, and others.

In an embodiment, the monooxygenase is not a toluene 4-monooxygenase when the microorganism is *Escherichia coli*. In an embodiment, the methane monooxygenase is not from *Methylococcus capsulatus* when the microorganism is *Escherichia coli*. In an embodiment, the monooxygenase is not a methane monooxygenase from *Methylococcus capsulatus* when the MMOC, MMOB, MMOX, MMOY, and MMOZ subunits are expressed in *Escherichia coli*. In an embodiment, the monooxygenase is not a methane monooxygenase from *Methylococcus capsulatus* when the MMOC, MMOB, MMOX, MMOY, and MMOZ subunits are expressed in *Escherichia coli* when the chaperones GroEL and GroES from *Escherichia coli* are overexpressed. In an embodiment, the monooxygenase is not a methane monooxygenase from *Methylococcus capsulatus* when the MMOC, MMOB, MMOX, MMOY, and MMOZ subunits are expressed in *Escherichia coli* when the chaperones GroEL and GroES from *Escherichia coli* are overexpressed from a plasmid. In an embodiment, the monooxygenase is not a methane monooxygenase from *Methylococcus capsulatus* when the MMOC, MMOB, MMOX, MMOY, and MMOZ subunits are expressed in *Escherichia coli* when the chaperones GroEL and GroES from *Escherichia coli* are overexpressed from a plasmid for use in an anaerobic atmosphere. In an embodiment, the monooxygenase is not a methane monooxygenase from *Methylococcus capsulatus* when the MMOC, MMOB, MMOX, MMOY, and MMOZ subunits are expressed in *Escherichia coli* when the chaperones GroEL and GroES from *Escherichia coli* are overexpressed from a plasmid for use in a cow's rumen. In an embodiment, the monooxygenase is not the monooxygenase genes from *Methylococcus capsulatus* when transferred into the pSBA1A3 vector.

In an embodiment, the monooxygenase is not the methane monooxygenase from either *Methylococcus capsulatus* or *Methylosinus trichosporium* OB3b when expressed in *Methylocystis Parvus* OBBP or *Methylomicrobium album* BG8. In an embodiment, the monooxygenase is not the soluble methane monooxygenase from *Methylosinus trichosporium* OB3b when expressed in *Methylocystis Parvus* OBBP. In an embodiment, the monooxygenase is not the monooxygenase from either *Methylococcus capsulatus* or *Methylosinus trichosporium* OB3b when expressed in *Methylomicrobium album* BG8 in low copper to biomass ratios.

In an embodiment, the synthetic microorganism is not an *Escherichia coli* with a mutation at position 267 of the adhE gene as set forth in SEQ ID NO: 49. In an embodiment, the synthetic microorganism is not *Escherichia coli* with a mutation of a T for an A at position 267 and a K for an E at position 568 of the adhE gene as set forth in SEQ ID NO: 49.

In an embodiment, the monooxygenase is not an actinomycetes monooxygenase when expressed in *Escherichia coli*, especially when expressed with the GroEL-like protein MimG. In an embodiment, the monooxygenase is not the methane monooxygenase from either *Mycobacterium smegmatis* or *Mycobacterium goodii* when expressed in *Escherichia coli* with the GroEL-like protein MimG. In an embodiment, the monooxygenase is not the methane monooxygenase from either *Mycobacterium smegmatis* or *Mycobacterium goodii* when expressed in *Escherichia coli* with the GroEL-like protein MimG; wherein the mimB and/or mimD gene has or have been optimized for expression in *Escherichia coli*.

EXAMPLES

Example 1. Active Soluble Diiron Monooxygenase Converts Ethane to Ethanol

This example describes a strain and method for culturing a strain to produce ethanol from an ethane feedstock.

Yeast strains have been used to produce ethanol in fermentations of sugar for thousands of years. As such, there are numerous strains of yeast that have been identified to tolerate high levels of ethanol. Ethanol is a commercially useful product for a range of applications including cleaning products and transportation fuels.

The techniques for constructing a yeast strain that is expressing a heterologous enzyme, enzyme complex, or multiple enzymes or enzyme complexes have been described elsewhere herein. Briefly, each gene is expressed from a unique promoter. The gene can be expressed from a plasmid or from a chromosomal locus. In some cases, additional proteins may assist in the folding or assembly of the enzyme or enzyme complex.

The ethane monooxygenase may be selected from Table 16. Any additional genetic elements may be identified as described herein and expressed in a similar manner A yeast strain expressing a functional ethane monooxygenase is capable of converting ethane into ethanol. While under certain conditions, the yeast strain may consume the ethanol as a carbon or energy source; under other conditions, the yeast strain may overproduce the ethanol and secrete it into the culture medium.

This strain may be cultured in a minimal media containing glucose (or other sugars or starches), glycerol, ethanol or ethane as the carbon and energy source. After the strain has reached a sufficient cell density in the culture, the culture can be switched into a minimal media containing no carbon source and these cells can be used to perform a bioconversion of ethane into ethanol by providing ethane in the headspace. Alternatively, the strain can be cultured in a bioreactor in which the ethane (and other gases, such as oxygen) can be continuously bubbled or sparged.

Once the ethanol is produced in sufficient quantity, it can be separated in batch or continuously by methods such as distillation or evaporation.

Though this example describes an example of producing ethanol from ethane in a yeast strain, such as *Saccharomyces cerevisiae* or *Pichia pastoris*, there is not much difference, in principle, from using another strain, such as a bacterial strain like *Escherichia coli* or *Bacillus subtilis*, to produce ethanol. In any case, an important factor is the ethanol tolerance of the strain. Various strains, such as *E. coli*, have been engineered or adapted to higher levels of ethanol tolerance (H Chong et al., *Improving Ethanol Tolerance of Escherichia coli by Rewiring Its Global Regulator cAMP Receptor Protein (CRP)*, 8 PLoS ONE 1-9, 2013); (L H Luo et al., *Improved ethanol tolerance in Escherichia coli by changing the cellular fatty acids composition through genetic manipulation*, 31 Biotechnology letters 1867-1871, 2009), and these general procedures may be applied to other microbiological strains as well.

This part of the example describes work actually performed that describes a strain and method for culturing a strain to produce ethanol from an ethane feedstock.

The techniques for constructing an *E. coli* strain that expresses a heterologous enzyme, enzyme complex, or multiple enzymes or enzyme complexes have been described above and elsewhere. In this example, an enzyme capable of oxidizing ethane to ethanol was expressed from an inducible promoter on a plasmid in an *E. coli* strain and shown to convert ethane to ethanol.

The strain NH283 was constructed by the deletion of a region of DNA from the *E. coli* genome that contains the genes araBAD using the method of Datsenko and Wanner (K. Datsenko and B. Wanner, *One-step inactivation of chromosomal genes in Escherichia coli K-12 using PCR Products*, Proceedings of the National Academy of Sciences, Vol 97, Issue 12, p. 6640-5, 2000). Homology sequences were amplified from *E. coli* genomic DNA using primers LC95/LC96 (SEQ ID NO:3, SEQ ID NO:4) and LC97/LC98 (SEQ ID NO: 5, SEQ ID NO: 6). The antibiotic resistance gene cat was amplified from pKD3 using LC93/LC94 (SEQ ID NO: 1, SEQ ID NO: 2). These fragments were combined in a single tube and assembled using overlap extension PCR ("SOEing") with the outside primers LC96/LC98. Transformants were isolated on agar plates containing 17 µg/mL chloramphenicol and confirmed by colony PCR. NH283 was chosen as one of these clones to use in subsequent experiments.

Two plasmids were made, each of which contains the genes for the sMMO from *M. capsulatus* (Bath). The genomic region that contains the operon that expresses mmoX, mmoY, mmoB, mmoZ, mmoD, mmoC, hypothetical protein, mmoG, was amplified by PCR from *M. capsulatus* (Bath) genomic DNA. This region was Gibson-cloned (D. Gibson et al., *Enzymatic assembly of DNA molecules up to several hundred kilobases*, NATURE METHODS Vol 6, Issue 5, p. 343-345, 2009) behind either the arabinose-inducible pBAD promoter or the IPTG-inducible pTRC promoter in a plasmid with a p15A origin and also a gene for kanamycin resistance. The plasmids were sequence-confirmed by Sanger sequencing to contain the expected DNA sequence (listed in SEQ ID NO:19 and SEQ ID NO:26 below). The plasmids were separately transformed into strain NH283 (Table 2).

TABLE 2

Strains and plasmids

| Strain ID | Base strain genotype | Plasmid |
|---|---|---|
| NH283 | fhuA2 [lon] ompT gal sulA11 R(mcr-73::miniTn10--TetS)2 [dcm] R(zgb-210::Tn10--TetS) endA1 Δ(mcrC-mrr)114::IS10 Δ(araBAD)::cat | None |
| LC165 | fhuA2 [lon] ompT gal sulA11 R(mcr-73::miniTn10--TetS)2 [dcm] R(zgb-210::Tn10--TetS) endA1 Δ(mcrC-mrr)114::IS10 Δ(araBAD)::cat | pLC12 (p15A origin, Kan$^R$, empty plasmid control) |
| BZ11 | fhuA2 [lon] ompT gal sulA11 R(mcr-73::miniTn10--TetS)2 [dcm] R(zgb-210::Tn10--TetS) endA1 Δ(mcrC-mrr)114::IS10 Δ(araBAD)::cat | pBZ4 (p15A origin, Kan$^R$, pTRC_mmoX, mmoY, mmoB, mmoZ, mmoD, mmoC, hypothetical protein, mmoG); SEQ ID NO: 19 |
| LC168 | fhuA2 [lon] ompT gal sulA11 R(mcr-73::miniTn10--TetS)2 [dcm] R(zgb-210::Tn10--TetS) endA1 Δ(mcrC-mrr)114::IS10 Δ(araBAD)::cat | pLC39 (p15A origin, Kan$^R$, pBAD_mmoX, mmoY, mmoB, mmoZ, mmoD, mmoC, hypothetical protein, mmoG); SEQ ID NO: 26 |
| LC160 | fhuA2 [lon] ompT gal sulA11 R(mcr-73::miniTn10--TetS)2 [dcm] R(zgb-210::Tn10--TetS) endA1 Δ(mcrC-mrr)114::IS10 Δ(araBAD)::cat | pLC37 (cloDF13 origin, Kan$^R$, Spec$^R$, pBAD_mmoX, mmoY, mmoB, mmoZ, mmoD, mmoC, hypothetical protein, mmoG; P$_{constitutive}$_E. coli groESL); SEQ ID NO: 25 |

The following describes the method for culturing the strains and measuring the bioconversion of ethane to ethanol. All strains were inoculated in 1 mL LB Miller supplemented with kanamycin (50 μg/mL) and grown at 37° C. for 18 hours with shaking at 280 rpm. The cultures grew to stationary phase and 0.1 mL of these cultures was then used to inoculate two flasks containing sterile 10 mL LB+kanamycin (50 μg/mL)+either 1 mM IPTG or 1 mM arabinose. The cultures were grown with shaking at 37° C. until OD600~1.2 (approximately 4.0-4.5 hours). The cells were spun for 5 minutes at 4000 rpm, and re-suspended in 10 mL phosphate buffer solution (PBS). This 10 mL was split equally into two glass serum bottles, 5 mL in each. The bottles were then sealed with butyl rubber stoppers. A volume of 60 mL of either ethane or air was measured into syringes and injected through the stopper and into each of the two bottles. The bottles were shaken at 37° C. for 7 days, at which point the supernatant was sampled in order to measure ethanol concentration.

Figure 2:
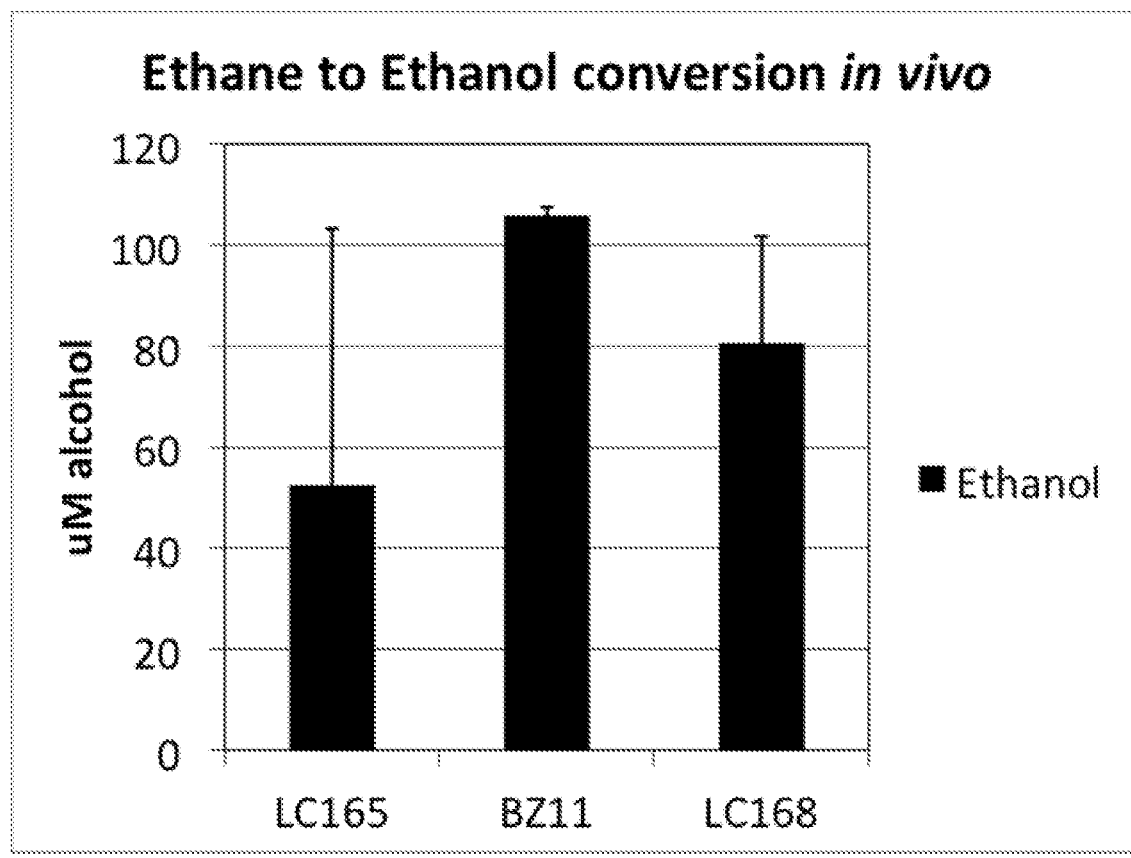
FIG. 2 shows the comparison of the amount of ethanol generated in three strains: LC165 (control), BZ11 (inducible sMMO converting ethane to ethanol), and LC168 (inducible sMMO converting ethane to ethanol).

Ethanol was measured using a colorimetric assay (Cell Biolabs catalog number STA-620). Briefly, it measures ethanol using an enzymatic reaction that produces hydrogen peroxide, which reacts with a colorimetric probe. 90 μL of a reaction mixture was combined with 10 μL of sample, and incubated at 37° C. for 30 minutes. The composition of the assay mixture is described in Table 3. The absorbance at 570 nm was compared to a standard curve, and ethanol in each sample was quantified. FIG. 2 compares the conversion of ethane to ethanol in three strains of *E. coli*. The control strain (left) had no ethane-oxidizing enzyme, and this strain does not convert ethane to ethanol. The two other strains had ethane-oxidizing enzymes and they converted ethane to ethanol.

TABLE 3

| Composition of the reaction mixture for the ethanol assay | |
|---|---|
| Deionized water (mL) | 2.175 |
| 10x assay buffer (mL) | 0.25 |
| 100x Enzyme mixture (μL) | 25 |
| 50x colorimetric probe (μL) | 50 |
| Total reaction volume (mL) | 2.5 |

After raw absorbance data was collected, the data were processed as follows: Background absorbance (media only) was subtracted from all samples, including the calibration samples. Each strain had been tested either with air injected or with ethane injected. The absorbance from the air-injected sample was subtracted from the absorbance from the ethane-injected sample. This absorbance value was compared with the calibration curve to determine the amount of the ethanol. The data shown in FIG. 2 demonstrate the production of ethanol under conditions where the strain is expressing the monooxygenase enzyme.

Example 2. Active Soluble Diiron Monooxygenase in *E. coli* Converts Methane into Methanol This example describes a strain and method for culturing a strain to produce methanol from a methane feedstock.

In this example, the same soluble diiron monooxygenase enzyme capable of oxidizing ethane to ethanol in Example 1 above was shown to convert methane to methanol. The strains and plasmids, as well as their methods of construction, are identical to those in Example 1. The method of analysis is also nearly identical, with the following modifications.

Figure 3:
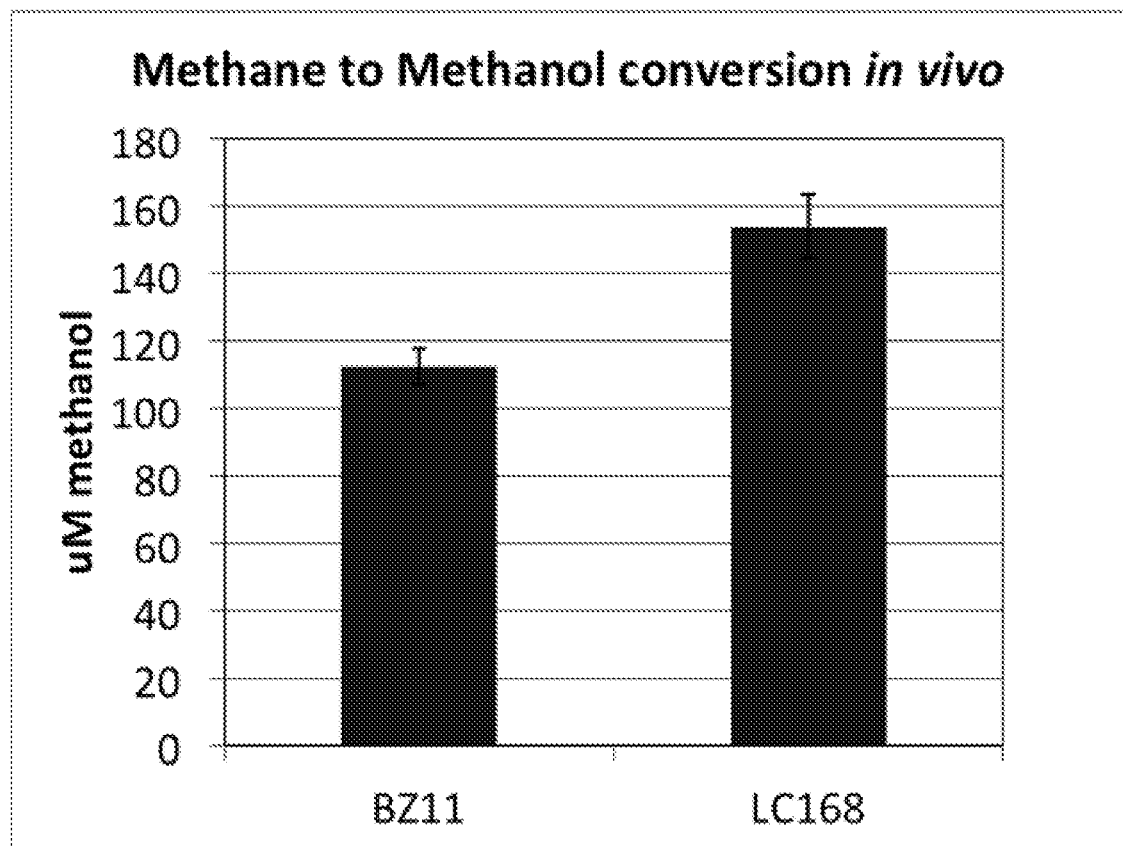
FIG. 3 shows the production of methanol from a methane feedstock. *E. coli* strains BZ11 and LC168 each express a functional monooxygenase.

The headspace above the culture in the stoppered, glass serum bottles were injected with methane, instead of ethane. Subsequently, the colorimetric analysis measures the methanol concentration in the sample taken from the serum bottle, using the same method of determining first a standard curve, adjusting the samples to their corresponding air-injected sample control and then comparing this absorbance (the difference of methane-injected minus air-injected absorbances) to that standard curve. The background value for the control strain is subtracted and those values are plotted for strains BZ11 and LC168 in FIG. 3.

Example 3. Strain Improvements to Increase Conversion of Methane and Ethane into Methanol and Ethanol by an Engineered *E. coli*

This example describes an improved strain and method for culturing a strain to produce methanol from a methane feedstock or ethanol from an ethane feedstock.

Improved strains may be constructed using a variety of techniques known to those skilled in the art. Some of those techniques include: changing plasmid copy number, changing promoter strength, varying inducer concentration, varying cultivation temperature, integrating genes into the chromosome, combining multiple genes on one plasmid, separating genes onto multiple plasmids.

LC160 is similar to strain LC168, except for the origin of replication (cloDF13 instead of p15A) and also has a second operon, which constitutively expresses the *E. coli* genes groES and groEL. The DNA sequence for the groES/groEL operon was amplified from *E. coli* genomic DNA (Table 2). Sequence for the plasmid in LC160 is provided as SEQ ID NO:25.

Figure 4:
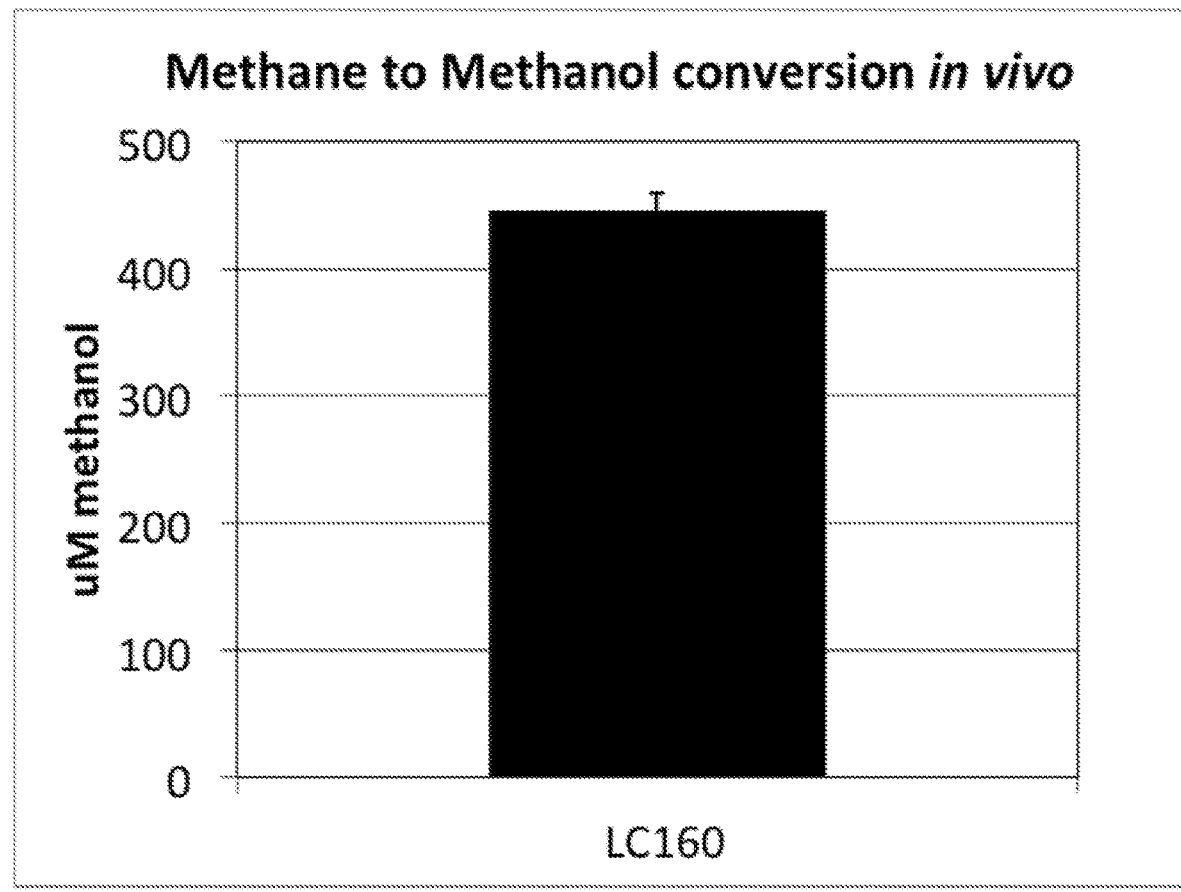
FIG. 4 shows the amount of methanol generated in LC160 (inducible sMMO converting methane to methanol). *E. coli* strain LC160 expresses both a functional monooxygenase and overexpression of *E. coli* groES and groEL genes.

Cells were cultured and methanol was measured as described in herein. FIG. 4 illustrates the conversion of methane to methanol in *E. coli*. The control strain LC165 has no methane-oxidizing enzyme, and this strain does not convert methane to methanol. The strain LC160 (FIG. 4) expressed sMMO from *M. capsulatus* and groESL from *E. coli*. More than 400 μM of methanol was measured resulting from the bioconversion of methane to methanol in LC160.

Figure 5:
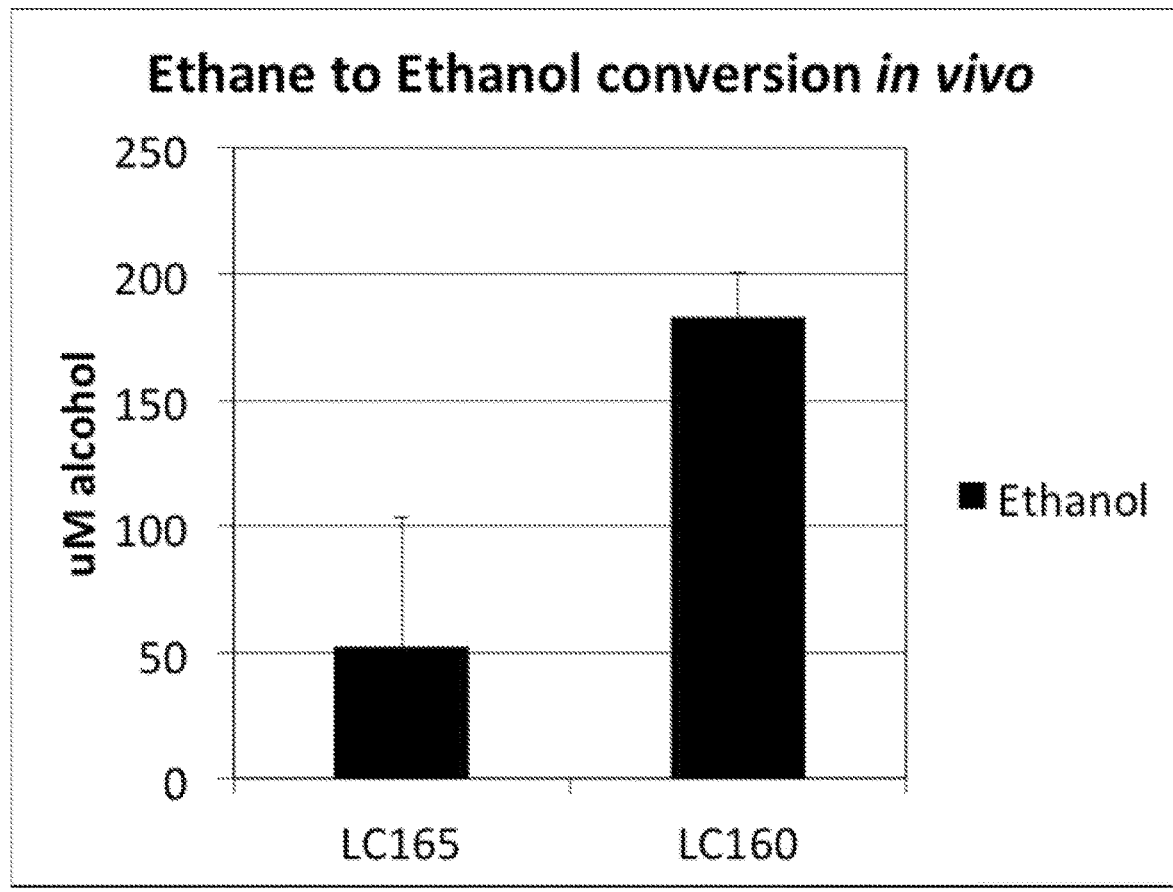
FIG. 5 shows the improved production of ethanol from an ethane feedstock. *E. coli* strain LC160 expresses both a functional monooxygenase and overexpression of *E. coli* groES and groEL genes.

Cells were cultured and ethanol was measured as described herein. FIG. 5 compares the conversion of ethane to ethanol in two strains of *E. coli*. The control strain LC165 (FIG. 5, left) has no ethane-oxidizing enzyme, and this strain does not convert ethane to ethanol. The strain LC160 (FIG. 5, right) expressed sMMO from *M. capsulatus* and groESL from *E. coli*.

Example 4. Bioconversion of Naphthalene to 1-Naphthol in *E. coli*

Figure 10:
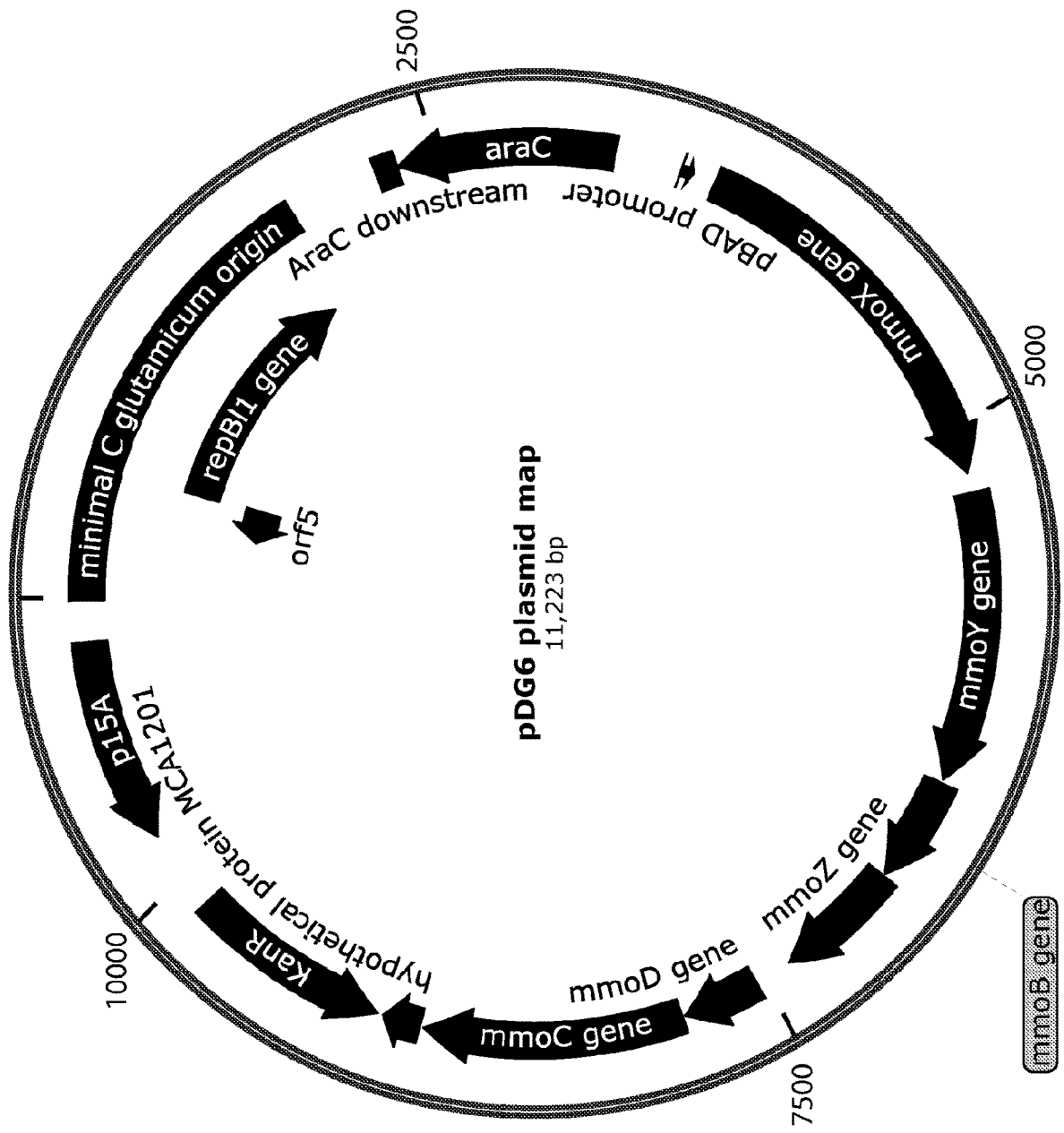
FIG. 10 shows a representative plasmid map illustrating the coding regions for plasmid pDG6 (SEQ ID NO: 22). This plasmid enables the expression of the *M. capsulatus* (Bath) sMMO genes mmoXYBZCD, linked to the pBAD promoter. The plasmid map for pDG5 (SEQ ID NO: 21) would be nearly identical with the sole addition of *M. capsulatus* (Bath) mmoG gene at the 3' end of the MMO operon.
Figure 11:
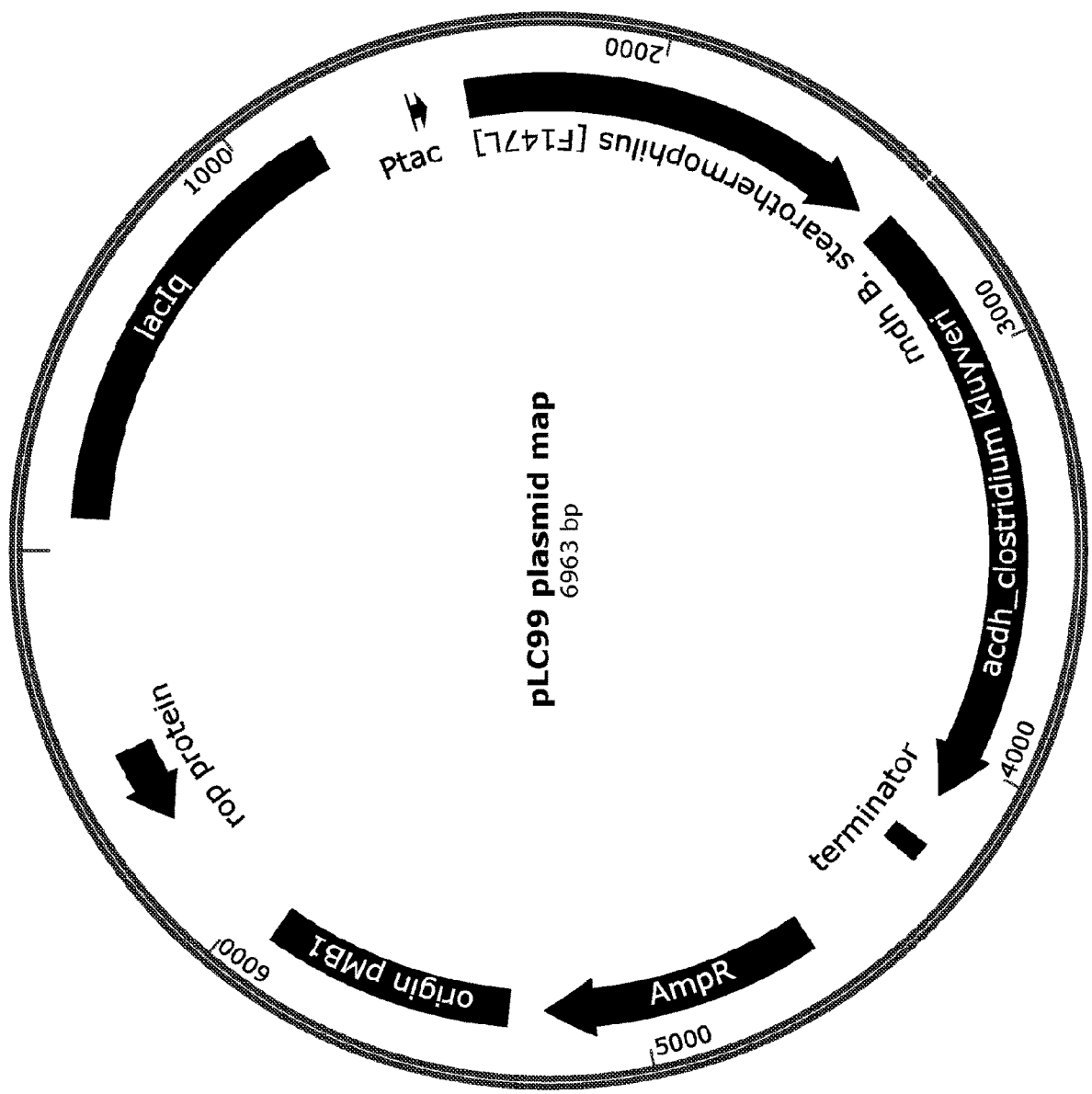
FIG. 11 shows a representative plasmid map illustrating the coding regions for plasmid pLC99 (SEQ ID NO: 27). This plasmid enables the expression of an ethanol-assimilation pathway in *E. coli*. The plasmid map for pLC100 (SEQ ID NO: 23) would be nearly identical, since the only changes are the nucleotides around the ribosome binding sites to the 5' side of the two ethanol-assimilation genes.
Figure 12:
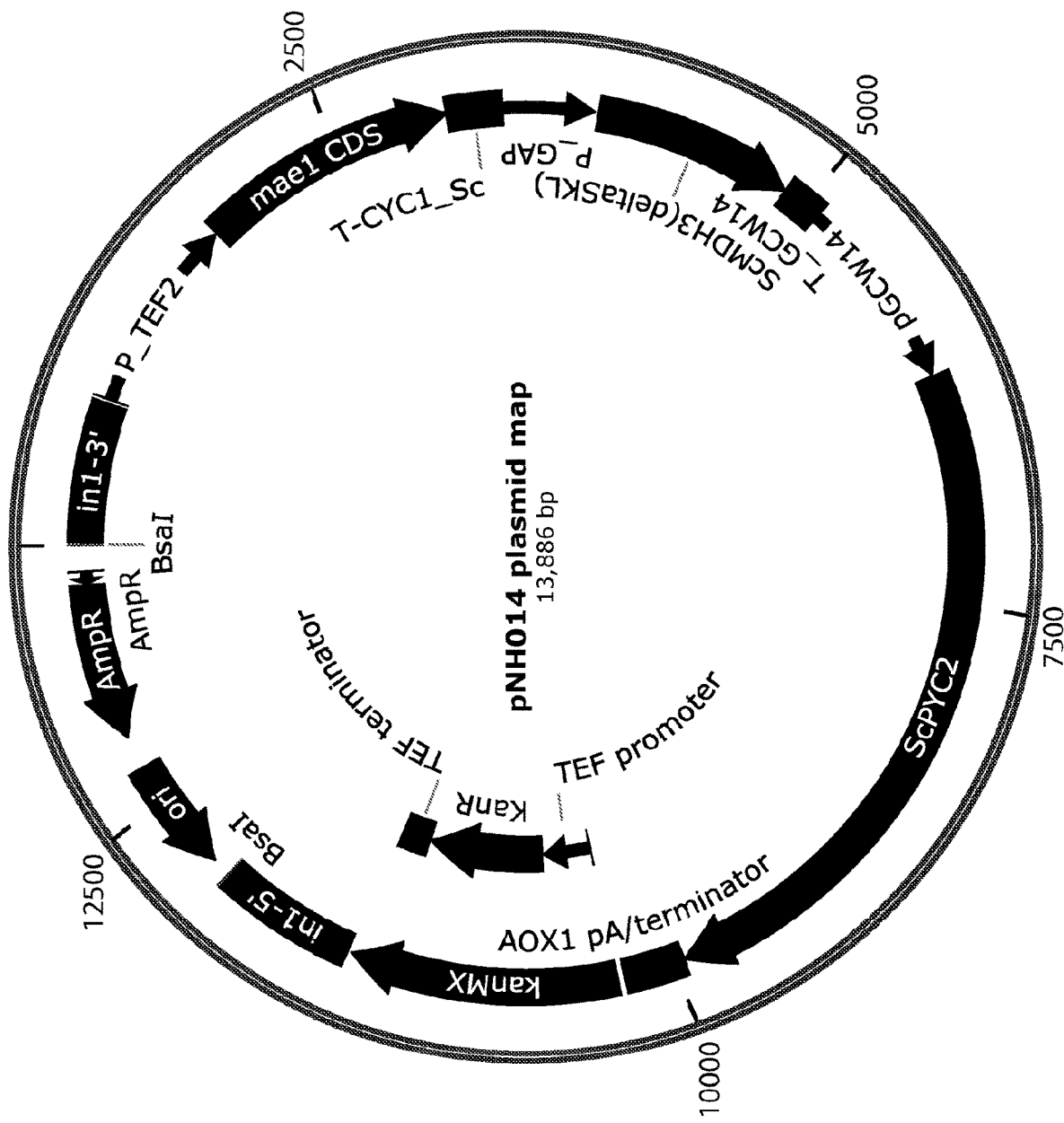
FIG. 12 shows a representative plasmid map illustrating the coding regions for plasmid pNH014 (SEQ ID NO: 57). This plasmid enables the expression of a 3-gene malate-production pathway in *Pichia pastoris*.
Figure 13:
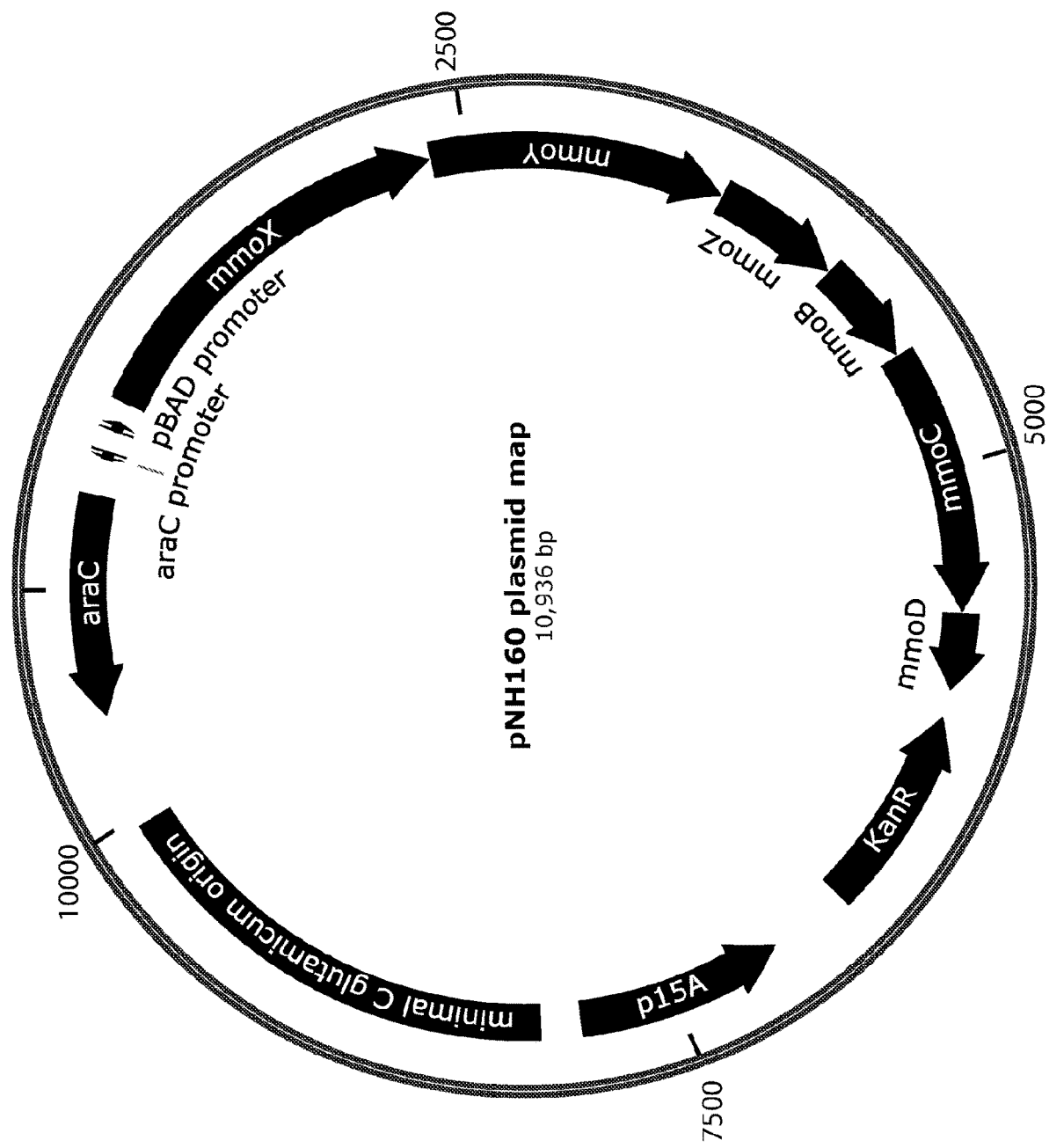
FIG. 13 shows a representative plasmid map illustrating the coding regions for plasmid pNH160 (SEQ ID NO: 33). This plasmid enables the expression of soluble diiron monooxygenase from *Solimonas aquatica* in *E. coli*. The plasmids pNH157 (SEQ ID NO: 31), pNH158 (SEQ ID NO: 32), and pNH100 (SEQ ID NO: 28) are nearly identical, with the exception of the substitution of the coding sequences of the *S. aquatica* monooxygenase being replaced with those of *Methylocaldum* sp. 175, *Methyloferula stellata*, and *Pseudonocardia* TY7, respectively.
Figure 14:
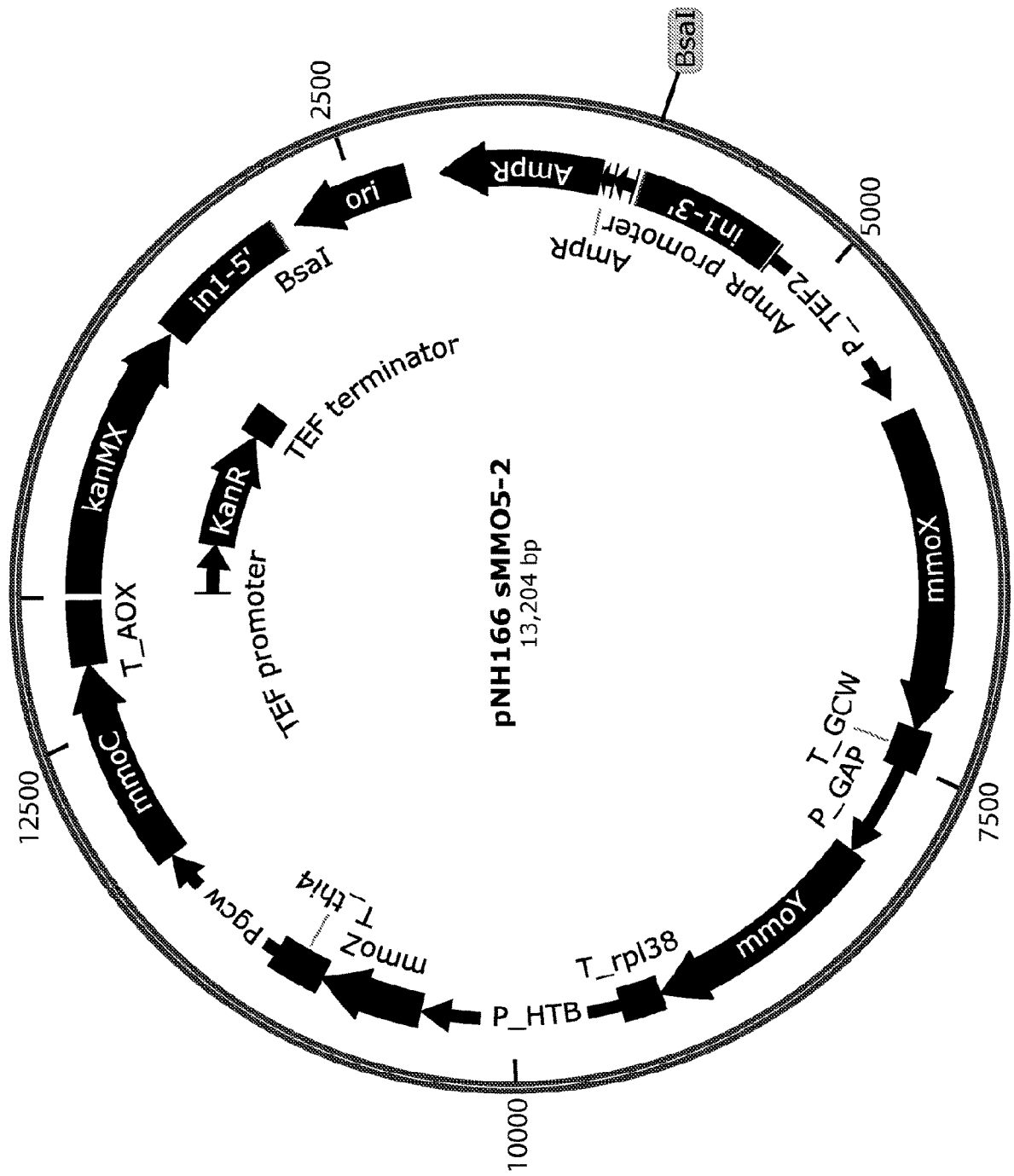
FIG. 14 shows a representative plasmid map illustrating the coding regions for plasmid pNH166 (SEQ ID NO: 34). This plasmid enables the expression of four subunits of the *Methylocystis* methane monooxygenase mmoX, mmoY, mmoZ, and mmoC from different promoters for expression in *Pichia pastoris*. This plasmid can be restriction digested with BsaI enzyme in order to generate a linear fragment for integration into the chromosome. The plasmid pNH167 (SEQ ID NO: 35) is nearly identical, with the exception being the substitution of the coding sequences for the MMO subunits deriving from *Solimonas aquatica*.
Figure 15:
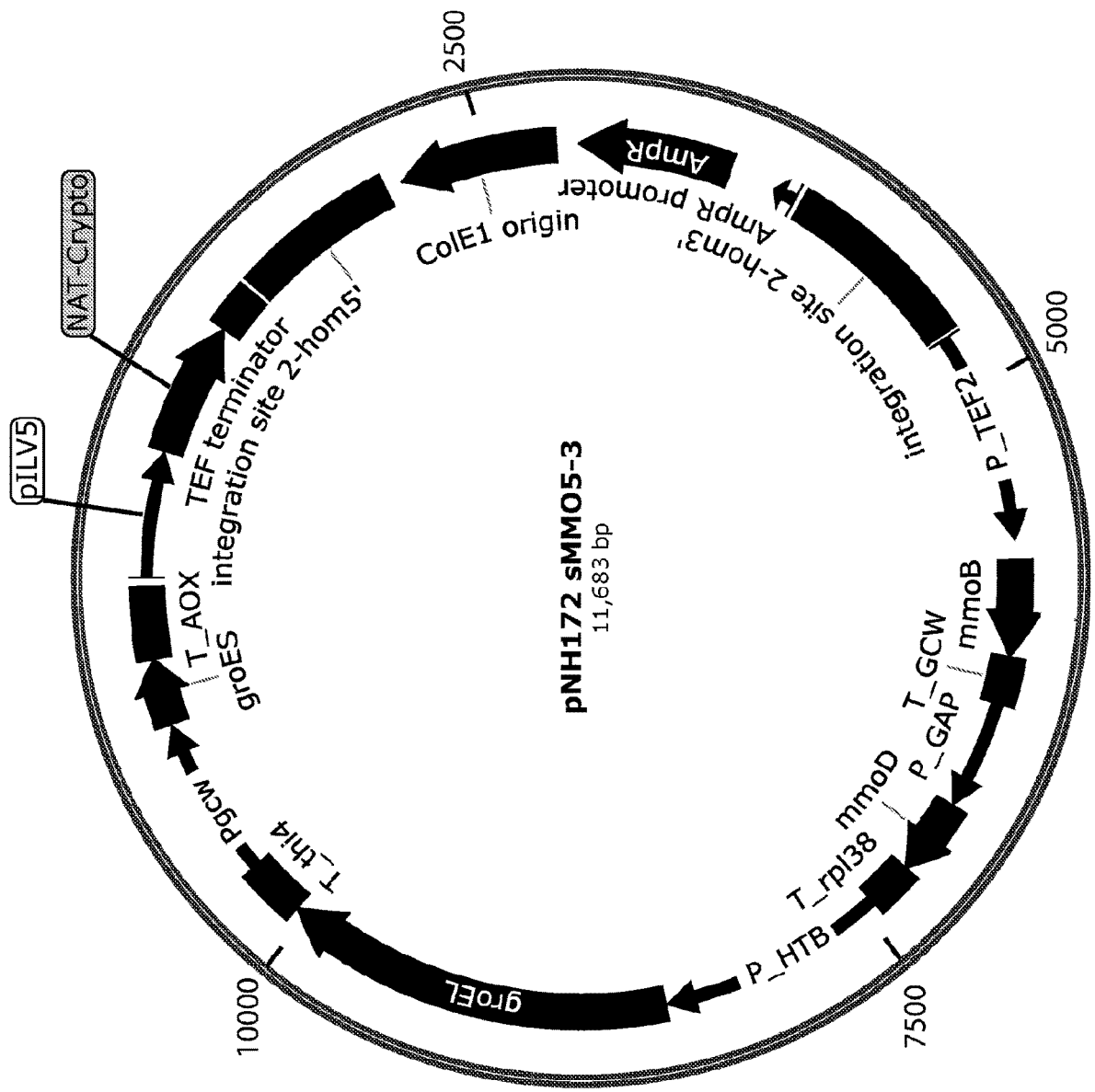
FIG. 15 shows a representative plasmid map illustrating the coding regions for plasmid pNH172 (SEQ ID NO: 36). This plasmid enables the expression of two subunits of the *Methylocystis* methane monooxygenase mmoB and mmoD, plus the *Methylocystis* chaperone groES and groEL from different promoters for expression in *Pichia pastoris*. This plasmid can be restriction digested with BsaI enzyme in order to generate a linear fragment for integration into the chromosome. The plasmid pNH173 (SEQ ID NO: 37) is nearly identical, with the exception being the substitution of the coding sequences for the MMO subunits and chaperones deriving from *Solimonas aquatica*.
Figure 16:
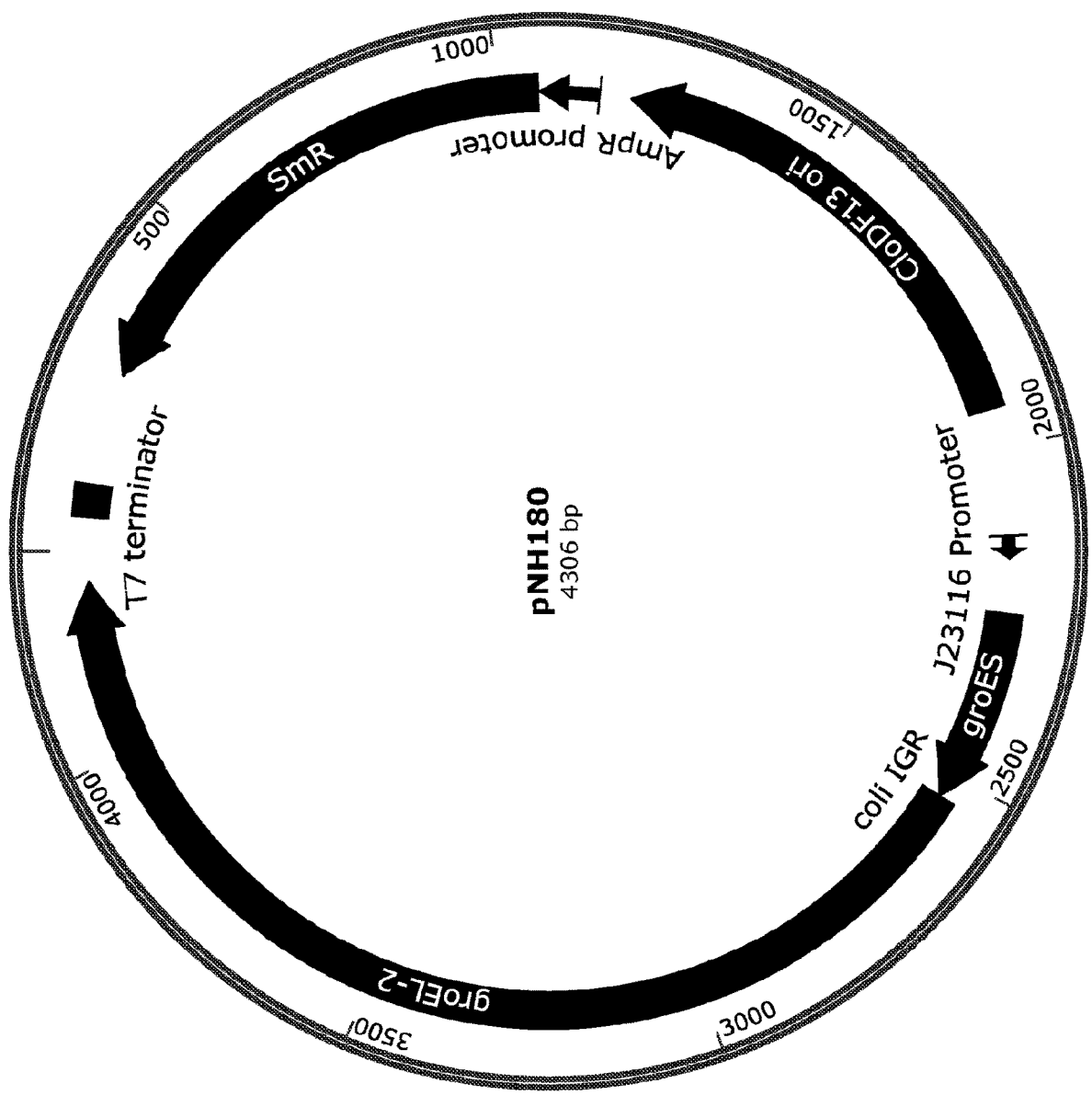
FIG. 16 shows a representative plasmid map illustrating the coding regions for plasmid pNH180 (SEQ ID NO: 40). This plasmid enables the expression of the *M. capsulatus* (Bath) chaperones groES and groEL-2 for expression in *E. coli*. The plasmids pNH177 (SEQ ID NO: 38), pNH178 (SEQ ID NO: 39), pNH181 (SEQ ID NO: 41), pNH185 (SEQ ID NO: 42), pNH187 (SEQ ID NO: 43), and pNH188 (SEQ ID NO: 44) are all nearly identical to plasmid pNH180, with the exception of the substitution of the coding sequences for the groES and groEL genes deriving from *Pseudonocardia autotrophica, Thauera butanivora, Methylosinus trichosporium, Methylocaldum* sp. 175, *Methylocystis* sp. LW5, and *Solimonas aquatica*, respectively.
Figure 17:
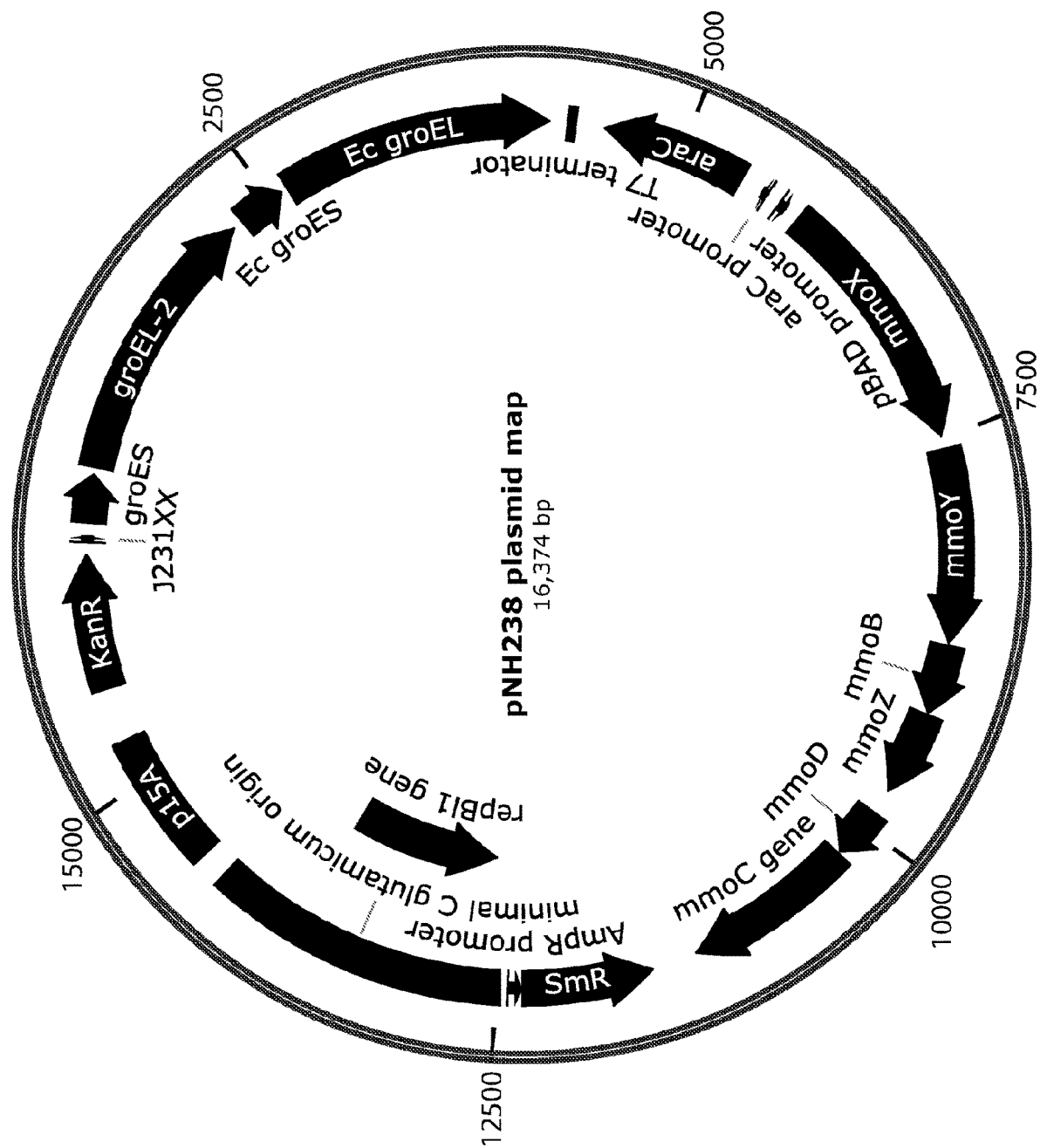
FIG. 17 shows a representative plasmid map illustrating the coding regions for plasmid pNH238 (SEQ ID NO: 46). This plasmid enables the expression of the *M. capsulatus* (Bath) sMMO subunits and groES/groEL-2 genes, plus the *E. coli* groES/groEL chaperone genes for expression in *E. coli, C. glutamicum*, and other Gram-positive bacteria. The plasmid pBZ21 (SEQ ID NO: 17) is nearly identical, with the exception of the fragment containing the *C. glutamicum* origin of replication and the KanR cassette.

The following describes the high-throughput method for culturing the strains and measuring the bioconversion of naphthalene to 1-naphthol by sMMO in multi-well microplates. The plasmid pDG5 (SEQ ID NO: 21) was constructed by amplification of the relevant section of genomic DNA from *Methylococcus capsulatus* (Bath) containing the MMO operon of genes mmoXYBZCDG and cloning this DNA fragment into a pACYC vector containing a p15a origin of replication, a kanamycin-resistance gene, and a pBAD promoter. This plasmid pDG5 is nearly identical to the plasmid pDG6 (SEQ ID NO: 22, FIG. 10), except for the presence of mmoG (groEL-2) at the 3' end of the operon. Strain LC151 was constructed by transforming strain NH283 with plasmid pDG5 and selecting for transformants on LB agar plates supplemented with kanamycin at 50

µg/mL. All strains were inoculated in 2 mL 96-well plates with each well containing 0.4 mL LB media supplemented with antibiotics as appropriate (kanamycin at 50 µg/mL and spectinomycin at 100 µg/mL) and grown at 37° C. overnight with shaking. For the induction of sMMO, aliquots of 40 µL/well of overnight seed cultures were inoculated in fresh 96-well plates with each well containing 400 µL LB culture media supplemented with antibiotics and 1.0 mM L-arabinose. The cultures were grown with shaking at 37° C. for 4 to 5 hours. The cells were spun for 10 minutes at 3700×g, and the spent LB media was removed by a 96-pin aspirator connected to a vacuum pump. The cells were re-suspended in 1.0 mL of phosphate buffered saline (PBS) and spun again for 10 minutes at 3700×g, the PBS wash buffer was again removed by aspiration. The washed cell pellets were re-suspended in 0.25 mL of PBS assay buffer containing 0.4% glycerol (v/v), 1 mM L-arabinose, and 80 µM $FeSO_4$.

The naphthalene assay plate was prepared by adding 10 µL/well of 0.5 M naphthalene dissolved in pure ethyl alcohol. Small naphthalene crystals formed at the bottom of each well after all alcohol evaporated, approximately 2 hours. Aliquots of 200 µL/well of the re-suspended cells in assay buffer were transferred into the naphthalene plate and mixed with naphthalene crystals. The naphthalene assay plate was then sealed and incubated at 37° C. overnight with shaking. The supernatant containing 1-naphthol was separated from cell pellets by spinning the assay plate for 10 minutes at 3700×g, and supernatant of 150 µL/well was transferred into a 96-well clear flat-bottom microtiter plate.

1-naphthol was measured using a colorimetric assay. The 1-naphthol in the 150 µL supernatant was reacted with 50 µL of freshly prepared 0.2% (w/w) solution by dissolving Fast Blue B (tetrazotized o-dianisidine) in deionized water. The colored diazo complex was measured on a plate reader at 540 nM. The concentration of the diazo complex is proportional to the concentration of the 1-naphthol product.

Figure 6:
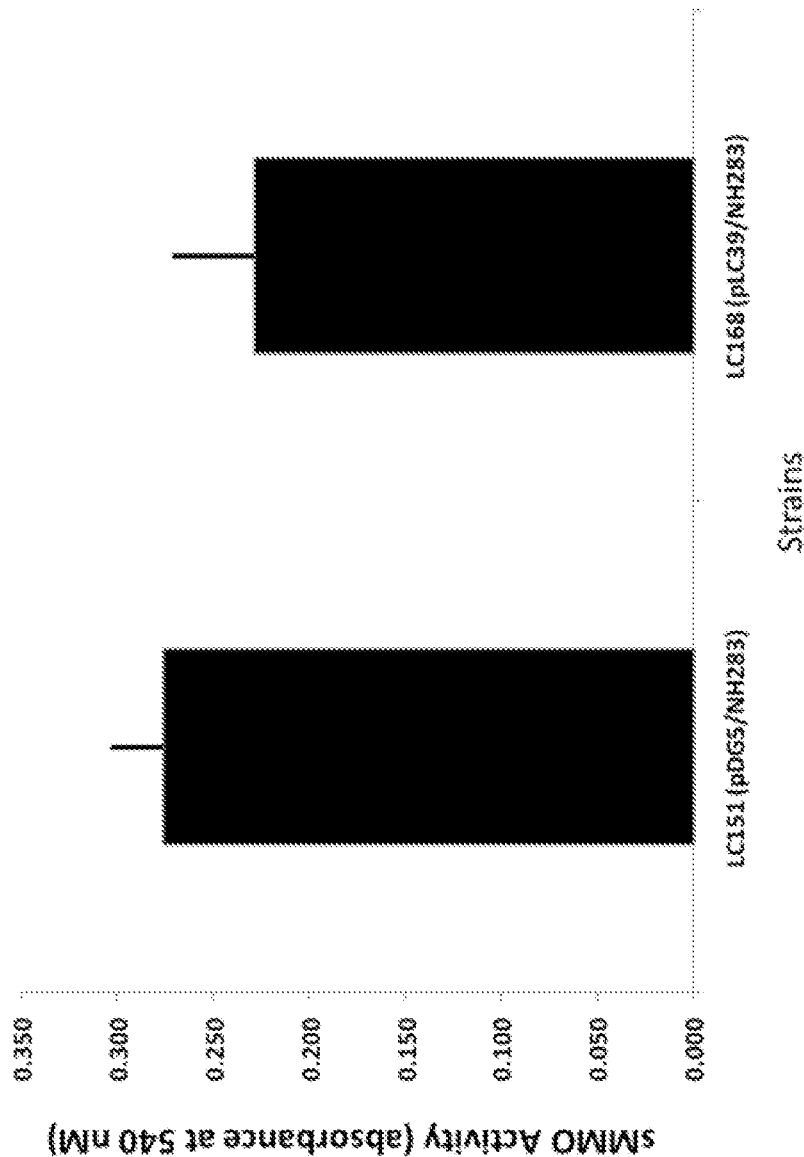
FIG. 6 shows the production of 1-naphthol from a naphthalene feedstock. *E. coli* strains LC151 and LC168 each express a functional monooxygenase. The 1-naphthol concentration is measured by the addition of a naphthol-sensitive dye and subsequent measurement of the optical absorbance at 540 nm. The absorbance value of a control strain (lacking any monooxygenase) is subtracted as a baseline value.

The sMMO activity was expressed as relative absorbance (A540) after subtracting buffer blank and the absorbance in the empty vector control strain LC165. As shown in FIG. 6, both strains (LC151 and LC168) expressing the *M. capsulatus* sMMO operon showed significantly higher activities than LC165 expressing the empty vector control.

This is the first example for successful expression of active *M. capsulatus* sMMOs in engineered *E. coli* strains that can be detected by the naphthalene colorimetric assay. The high throughput method described here can be used for strain improvement by optimizing and balancing sMMOs and their homologs in *E. coli* and other heterologous hosts.

Example 5. Chaperone Expression Improves MMO Activity: Naphthalene to Naphthol

In one example we showed that the *M. capsulatus* MMOG, a groEL-2 chaperone homolog, is critical for MMO activity in *E. coli* strains expressing a native *M. capsulatus* MMO operon on single plasmids (pDG5 (SEQ ID NO: 21), pLC39 (SEQ ID NO: 26)). In another example we further demonstrated that a re-factored *M. capsulatus* groES-EL2 operon on a compatible plasmid (pNH180 (SEQ ID NO: 40)) greatly improved the MMO activity in *E. coli* strains harboring a mmoG-minus plasmid (pDG6 (SEQ ID NO: 22)).

This example describes a method that improved MMO activity by more than an order of magnitude. This novel approach involves overexpression of both the *E. coli* groES-groEL and the *M. capsulatus* groES-EL2 in pNH180. The *E. coli* groES-groEL fragment was PCR amplified from *E. coli* BW25113 genomic DNA, gel-purified, and cloned into a vector in front of a terminator sequence. After sequence verification, the groES-groEL-terminator fragment was amplified by PCR using primers BZ111 (SEQ ID NO:70) and LC166 (SEQ ID NO:71), gel purified, and cloned behind the *M. capsulatus* groES-EL2 in pNH180 by megapriming method (Ulrich et al., *Exponential Megapriming PCR (EMP) Cloning—Seamless DNA Insertion into Any Target Plasmid without Sequence Constraints*, PLoS One, 7(12), e53360, 2012). After DpnI digestion to remove the pNH180 plasmid DNA, the reaction mixture was transformed into NH283 carrying the MMO plasmid pDG6. The transformants were grown on an LB agar plate supplemented with kanamycin at 50 µg/mL for selection of pDG6 and spectinomycin at 100 µg/mL for selection of desired recombinant plasmid (pBZ13 (SEQ ID NO: 15)). A number of colonies were screened by naphthalene assay, leading to a new MMO strain (BZ25) carrying both pDG6 and pBZ13 plasmids. As shown in Table 4, MMO activity in BZ25 is a significant improvement over that of DG80. The pBZ13 plasmid was then separated from pDG6, purified, and sequence verified. One base strain (BZ26) was made by transforming the pBZ13 plasmid into NH283. The pDG6 plasmid was then introduced into BZ26 to confirm that the resulted strain is equivalent to the original BZ25.

TABLE 4

Improvement of MMO activity by co-expression of *M. capsulatus* and *E. coli* chaperone proteins

| Strain | Plasmids | *M. capsulatus* groES/groEL-2 | *E. coli* groES/groEL | MMO activity (A540 nm) |
|---|---|---|---|---|
| DG80 | pDG6, pNH180 | + | − | 0.07 |
| BZ25 | pDG6, pBZ13 | + | + | 1.15 |

Example 6. Chaperone Expression Improves MMO Activity: Methane to Methanol

This example describes the evaluation of the improved MMO strain (BZ25) for direct methane oxidation by a bio-conversion method detailed in Example 3. Both strains were grown in LB broth supplemented with kanamycin at 50 µg/mL and spectinomycin at 100 µg/mL. Method for MMO induction and bio-conversion of methane to methanol was performed as described elsewhere herein. The methanol titer was measured 20 hours after injection of methane gas. The MMO activity for DG80 and BZ25 are shown in Table 5.

TABLE 5

Methane oxidation by DG80 and BZ25

| Strain | MMO plasmid | Chaperone Plasmid | Methanol (mM)/OD600 |
|---|---|---|---|
| DG80 | pDG6 | pNH180 | 4.16 |
| BZ25 | pDG6 | pBZ13 | 6.33 |

Example 7. Homologs of Methane Monooxygenase in *E. coli*

Homologs of sMMO from *Methylococcus capsulatus* (Bath) can be determined using publicly available databases and search algorithms, such as BLASTp from NCBI. A wide range of sequences can be discovered in this manner and these sequences can be tested in the process described herein. The DNA sequences encoding these homologs can be extracted from genomic DNA isolates, PCR amplified from lysates of the relevant strains, or can be designed, codon optimized for expression in the desired host organism and synthesized using commercially available DNA synthesis services.

In one example, the DNA sequence encoding sMMO homologs from methanotrophs such as *Methylocella silvestris* and *Methylosinus trichosporium* was synthesized by a commercial vendor. The sequence was cloned into the same vector as that described herein, using standard techniques such as restriction digestion and isothermal assembly (D. Gibson et al., *Enzymatic assembly of DNA molecules up to several hundred kilobases*, NATURE METHODS Vol 6, Issue 5, p. 343-345, 2009). The assembled DNA was transformed into strain NH283 and verified by colony PCR and Sanger sequencing.

These strains can be tested using the same process as described herein.

Organisms were identified that contain homologs of the *M. capsulatus* sMMO. Sequences of the mmoXYBZDC genes from these organisms were codon optimized and synthesized in an operon using synthetic linkers containing strong ribosome binding sites between the genes. The groESL genes from these same organisms were similarly codon optimized and synthesized in an operon. Synthetic DNA was provided by a commercial vendor (Gen9, Inc.). Each operon was cloned into a different plasmid. The mmoXYBZDC operons were cloned into the plasmid pDG6 (SEQ ID NO: 22) backbone, which contains a pACYC origin, kanamycin resistance gene, araC repressor gene, and a pBAD promoter driving the expression of the operon. The groESL operons were transformed into the plasmid pDG11 backbone, which contains a cloDF13 origin, spectinomycin resistance gene, and synthetic J23116 promoter driving the expression of the operon.

For each organism, both plasmids were serially transformed into strain NH283 and selected on appropriate antibiotics. Source organisms for the sMMO and groESL enzymes are listed in Table 6, along with strain and plasmid names.

Plasmids pNH157 (SEQ ID NO: 31), pNH160 (SEQ ID NO: 33), and pDG6 (SEQ ID NO: 22) each contain 6 genes (mmoX, mmoY, mmoZ, mmoB, mmoC, mmoD) encoding an sMMO enzyme complex from a different organism. Plasmids pNH185 (SEQ ID NO: 42), pNH188 (SEQ ID NO: 44), and pNH180 (SEQ ID NO: 40) each contain 2 genes (groES, groEL) encoding a groESL enzyme complex from a different organism.

The following describes the method for culturing the strains and measuring the bioconversion of methane to methanol or ethane to ethanol. All strains were inoculated in 1 mL LB Miller supplemented with kanamycin (50 µg/mL) and spectinomycin (100 µg/mL) and grown at 37° C. for 18 hours with shaking. The cultures grew to stationary phase and 0.2 mL of these cultures was then used to inoculate flasks containing sterile 20 mL LB Miller, kanamycin (50 µg/mL), spectinomycin (100 µg/mL), 1 mM arabinose, and 80 µM FeSO$_4$. The cultures were grown with shaking at 37° C. for 5 hours. The cells were spun for 10 minutes at 4000 rpm, and washed in an equal volume of phosphate buffer solution pH 7.5 (PBS). The cells were spun again and re-suspended in an equal volume of PBS containing 1 mM arabinose, 80 µM FeSO$_4$, and 0.4% glycerol. Three aliquots of 5 mL each were transferred into identical glass serum bottles. The bottles were then sealed with butyl rubber stoppers. A volume of 60 mL of either methane, ethane, or air was measured into a syringe and injected through the stopper and into each of the bottles. The bottles were shaken at 37° C. for 43 hours, at which point the cell suspension was centrifuged and the supernatant was sampled in order to measure methanol and ethanol concentrations.

Alcohols were measured using a colorimetric assay described elsewhere herein (Cell Biolabs STA-620).

Table 6 shows the alcohol measurements. These data demonstrate that strains DG68, DG72, and DG80 containing diverse sMMO/groESL genes all have activity to oxidize methane to methanol, and also activity to oxidize ethane to ethanol. Percent homologies between enzymes is tabulated in Table 8.

TABLE 6

Methane and ethane oxidation activity of strains containing various homologs of sMMO and their cognate groESL enzymes.

| Strain | Plasmids | sMMO source | Methanol (mM) | Ethanol (mM) |
|---|---|---|---|---|
| DG68 | pNH157, pNH185 | *Methylocaldum* sp. 175 | 1.36 | 0.39 |
| DG72 | pNH160, pNH188 | *Solimonas aquatica* DSM 25927 | 0.027 | 0.12 |
| DG80 | pDG6, pNH180 | *Methylococcus capsulatus* (Bath) | 3.56 | 1.52 |

Example 8. MMO Enzyme Homologs are Active when Co-Expressed with a Heterologous Chaperone Organisms were identified that contain homologs of the *M. capsulatus* sMMO. The mmoXYBZDC and groESL genes were identified, codon-optimized, synthesized, cloned into vectors, and transformed into strain NH283 as described elsewhere herein.

Source organisms for the sMMO and groESL enzymes are listed in Table 7, along with strain and plasmid names. Percent homologies between homologs is tabulated in Table 8. Plasmids pNH157 (SEQ ID NO: 31), pNH158 (SEQ ID NO: 32), pNH160 (SEQ ID NO: 33), and pDG6 (SEQ ID NO: 22) each contain 6 genes (mmoX, mmoY, mmoZ, mmoB, mmoC, mmoD) encoding an sMMO enzyme complex from a different organism. Plasmids pNH185 (SEQ ID NO: 42), pNH188 (SEQ ID NO: 44), and pNH180 (SEQ ID NO: 40) each contain 2 genes (groES, groEL) encoding a groESL enzyme complex from a different organism.

The method for culturing the strains and measuring the bioconversion of methane to methanol or ethane to ethanol was performed as described herein. Measurement of alcohol concentrations, including use of air controls and technique for data processing, was performed as above.

Table 7 shows the alcohol measurements. These data demonstrate that strains DG68, DG69, DG71, DG72, DG73, and DG80 containing various combinations of sMMO and groESL genes all have activity to oxidize methane to methanol, and also activity to oxidize ethane to ethanol.

TABLE 7

Methane and ethane oxidation activity of strains containing diverse sMMO enzymes co-expressed with the chaperone groES/groEL from *M. capsulatus* (Bath).

| Strain | Plasmids | sMMO source | Methanol (mM) | Ethanol (mM) |
|---|---|---|---|---|
| DG69 | pNH157, pNH180 | *Methylocaldum* sp. 175 | 1.99 | 0.50 |
| DG71 | pNH158, pNH180 | *Methyloferula stellata* | 0.40 | 0.10 |
| DG73 | pNH160, pNH180 | *Solimonas aquatica* DSM 25927 | 0.025 | 0.96 |

TABLE 8

Percent identity between sMMO enzymes from different organisms. Values calculated using Clustal Omega for sMMO enzymes using mmoX sequences, using the definition of percent identity for multi-gene enzymes, as well as groEL and groES.

| sMMO Organism | *Solimonas aquatica* DSM 25927 | *Methyloferula stellata* | *Methylocaldum* sp.175 | *Methylococcus capsulatus* (Bath) |
|---|---|---|---|---|
| *Solimonas aquatica* DSM 25927 | 100.0% | 64.1% | 62.4% | 63.4% |
| *Methyloferula stellata* | | 100.0% | 82.5% | 83.3% |
| *Methylocaldum* sp. 175 | | | 100.0% | 95.3% |
| *Methylococcus capsulatus* (Bath) | | | | 100.0% |

| GroEL Organism | *Methylocaldum* sp175 | *Methylococcus capsulatus* (Bath) | *Solimonas aquatica* DSM 25927 |
|---|---|---|---|
| *Methylocaldum* sp. 175 | 100.0% | 50.3% | 43.6% |
| *M. capsulatus* (Bath) | | 100.0% | 49.2% |
| *Solimonas aquatica* DSM 25927 | | | 100.0% |

| GroES Organism | *Solimonas aquatica* DSM 25927 | *Methylococcus capsulatus* (Bath) | *Methylocaldum* sp175 |
|---|---|---|---|
| *Solimonas aquatica* DSM 25927 | 100.0% | 66.8% | 65.4% |
| *M. capsulatus* (Bath) | | 100.0% | 72.2% |
| *Methylocaldum* sp.175 | | | 100.0% |

The amino acid sequences for these enzymes were compared to each other using the online software Clustal Omega and the results are shown below in Table 8. The functional enzymes demonstrated in Table 7 show a low stringency of sequence identity between the mmoXYZCBD homologs, or between the groESL components.

The scope of the invention is meant to encompass variants of the synthetic nucleotides and/or amino acid sequences disclosed herein. As disclosed in scientific literature, in databases, in the present disclosure or as known to one skilled in the art at the filing date of the application, certain positions of a polypeptide sequence are typically conserved residues, which can be determined according to polar, electro-physical, hydrophobic and spatial properties of the polypeptide. One skilled in the art would be able to modify the amino acid sequences of the current disclosure, maintain conserved residues and/or apply conservative substitutions in those conserved residues and determine whether those variants still maintain functionality. FIG. 18 shows a multiple sequence alignment of the alpha subunit of the monooxygenase hydroxylase enzyme from three different microorganisms and is illustrative of the degree to which the monooxygenase amino acid sequences can be varied and maintain the observed function. Any mutation to one sequence that confers improved enzyme properties (e.g. activity and/or specificity) can be substituted into another homologous sequence using such a sequence alignment, using publicly available software such as BLASTp, for example, to identify the equivalent position in the homolog. It is clear to one skilled in the art how one would identify and construct the equivalent mutation in the homologous sequence.

The characteristics of soluble diiron monooxygenase enzymes have been studied in academia for years to understand the structure, function and mechanism. A paper by Coufal et al. in 2000 (Coufal et al., *Sequencing and analysis of the Methylococcus capsulatus (Bath) soluble methane monooxygenase genes*, Eur. J. Biochem., vol. 267, p. 2174-2185, 2000, which is incorporated by reference in its entirety herein, including any drawings) described conserved residues of the MMO subunits.

In the MMOX subunit of the MMOH enzyme, the iron ligand residue sequence pattern E . . . $EX_2H$ has been noted as a hallmark of proteins containing carboxylate-bridged non-heme diiron centers and is the only sequence conserved across the sMMO, R2, and stearoyl-ACP desaturase families. As such, there are often conserved residues in the following positions of SEQ ID NO:10: E114, E144, H147, E209, E243, and H246. Also, the lower half of the active site has a set of residues involved in hydrogen bonding between the C and F helices (D143, R146, 5238, D242, and R245) and are absolutely conserved among proteins. These residues might be part of a framework to hold the iron center in place or possibly to deliver protons to the active site. Two residues are conserved for steric reasons; both A117 and G250 are located in positions where the packing is very tight. Finally, there is a triad of surface-accessible residues, comprising A224, G228, and D229, located at the turn between helices E and F.

Conserved residues in other parts of the α-subunit are shown in FIG. 6. of Coufal. W371 is solvent exposed on one edge of the indole ring. Two Tyr residues are buried in the protein interior. In addition, a proline residue, P377, is absolutely conserved and may be important structurally. A model for the hydroxylase-reductase binding interaction places the reductase-binding site in this region, suggesting that this entire cluster of residues may serve as a docking site for another protein or as part of an electron-transfer path. In addition, T213, N214 may aid in proton transfer. Another set of conserved residues comprises P424, G443, P461 and Y464 and is located in the second domain of the hydroxylase α subunit. These amino acids are positioned slightly beneath the surface of the protein near the γ-subunit interface.

Finally, a set of residues found on the surface of the protein in the 'canyon' area above the active site is often conserved. These residues are Y67, K74, L321, G325, and P329, which are indicated in yellow in FIG. 6 of Coufal. It has been hypothesized that the canyon may be a docking site for protein B or possibly the reductase. Thus, these conserved residues may be important in mediating the interactions between two proteins. In particular, K74 and Y67 are very close to the surface and are located in the canyon. Combined with the E/F helix 'handle' described above, these residues might be key interaction points between the coupling protein B and the hydroxylase MMOH.

Figure 7:
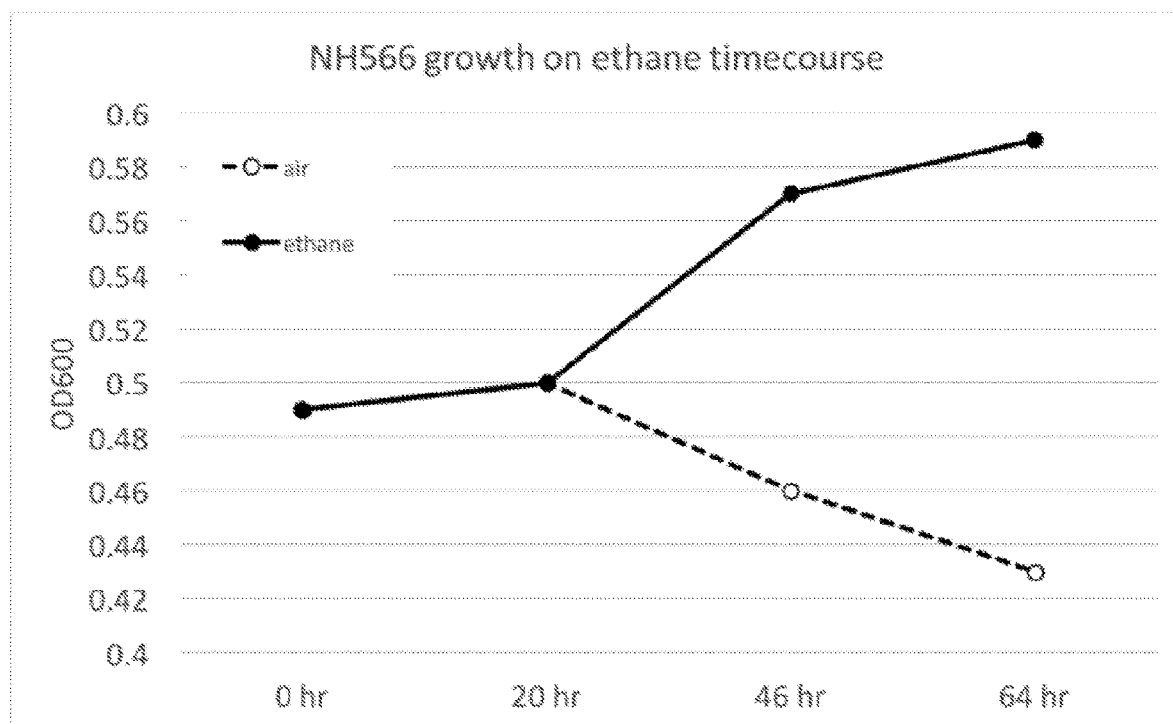
FIG. 7 shows the growth of NH566 on an ethane feedstock. Strain NH566 was sealed in two serum bottles, where one was injected with air and the other with ethane. This plot shows the culture density as a function of time after the injections which illustrates the increase in culture density for the bottle injected with ethane and a decrease in culture density for the bottle injected with air.

Additionally, in the β-subunit mmoY (SEQ ID NO:12), the interface between the α and β subunits comprising D100, P101, and D185 is conserved as seen in FIG. 7 Coufal. These residues may be involved in intersubunit interactions, although there are no conserved hydrogen-bonding or salt-bridge partners in the α subunit. A second group of residues, W218, R228 and A331, can be found under the surface of the β subunit, and a third set of amino acids containing mainly polar residues (D240, E243, Q313, and W320) is very near the protein surface. Further, 24 highly conserved residues have been identified in the alignment of the β-subunit analogs as seen FIG. 4A of Coufal. Most notably, two charged amino acids, K44 and E48, are conserved in the hydroxylase canyon, where they could participate in protein-protein interactions. The eight conserved aromatic residues may be part of an electron-transfer pathway from a putative reductase binding site on the β subunit to the diiron active site. It should be noted that no residue near the β-β interface is highly conserved across this group of enzymes. Protein B (SEQ ID NO:8) also has certain conserved residues. Sequence alignment of the coupling proteins (see Coufal, FIG. 4B) revealed five absolutely conserved residues (V38, E53, I79, G97, and G114), eight highly conserved residues (I52, V70, I85, E94, R98, V107, D108, and S111) and eight moderately conserved residues (V41, I55, V68, G83, V87, 192, L96, and F100). The surface of protein B is largely hydrophobic, making it well suited for binding the hydrophobic canyon on the hydroxylase. The MMOH-protein B docking model derived from NMR binding studies is consistent with the suggestion that hydrophobic interactions dominate hydroxylase-protein B binding and with cross-linking studies of the M. trichosporium OB3b sMMO system, in which protein B was shown to bind the α-subunit of the hydroxylase. The finding that many of these conserved residues, including L96, G97, F100, V107, D108, and G114, are affected by hydroxylase binding suggests that the hydroxylase-coupling protein-binding mode is similar for all of the enzyme systems examined. Therefore, using sequence homology alignments to identify protein-protein binding sites appears to be valid for this group of proteins. Complementary residues on the hydroxylase, presumably located in the canyon region, are likely to be conserved as well. Protein C (SEQ ID NO:59) also has conserved residues. The sMMO reductase is a member of the FNR family of oxidoreductases that contain well-characterized [2Fe-2S] and FAD cofactor sites and NADH-binding pockets. Conserved residues in the reductase components have been discussed previously.

If a residue is not conserved, it may be deleted, modified and/or replaced with another amino acid whose incorporation does not substantially affect functioning of the disclosed protein. Thus, the original peptides disclosed herein can be modified by the substitution of one or more residues at different, possibly selective, sites within the peptide. Such substitutions may be a conservative substitution, such as replacement of a hydrophobic residue with another hydrophobic residue, or may be less than conservative substitutions in the case where a particular residue is not a conserved residue. Some substitutions are tolerated better than others based upon the location of the residue. However, non-conservative or even radical substitutions may even be tolerated based upon the location of the residue, as can be demonstrated by one skilled in the art.

Substitutions are also meant to encompass those other than the common L-amino acids, such as D-amino acids or other amino acids with non-standard R groups. Each of these substitutions is intended to be within the disclosure of the application.

Example 9. Several Heterologous Chaperones Improve Methane into Methanol Conversion by sMMO This example describes the ability of the sMMO from M. capsulatus (Bath) to have improved activity against methane as a substrate with the coexpression of a panel of groES/groEL chaperones.

The strain NH283, described elsewhere herein, was transformed with two plasmids simultaneously: pDG6 (SEQ ID NO:22, containing the coding regions corresponding to the M. capsulatus (Bath) mmoX, mmoY, mmoZ, mmoC, mmoB, and mmoD genes) and one plasmid selected from the set of plasmids containing pNH178 (SEQ ID NO:39), pNH180 (SEQ ID NO:40), pNH181 (SEQ ID NO:41), pNH185 (SEQ ID NO:42), pNH187 (SEQ ID NO:43), and pCDF1b (SEQ ID NO:20) (containing codon-optimized groES/groEL genes from the microorganisms T. butanivorans, M. capsulatus, M. trichosporium, Methylocaldum sp. 175, Methylocystis sp. LW5, respectively, and a control vector pCDF1b). These transformants were selected on LB agar plates supplemented with kanamycin (50 μg/mL) and spectinomycin (100 μg/mL).

One colony of each of these transformations was selected for growth in 2 mL liquid LB media supplemented with antibiotics, as above, and incubated at 37° C., shaking at 280 rpm. After 16 hours, 1 mL of the culture was added to 10 mL of LB supplemented with kanamycin (50 µg/mL) and spectinomycin (100 µg/mL) and arabinose (1 mM) and FeSO$_4$ (80 µM) to induce the expression of the monooxygenase. Each 10 mL culture was incubated at 37° C., shaking at 280 rpm. After 4 hours, each culture was centrifuged and resuspended in 10 mL PBS to wash the cells. These were each centrifuged again and resuspended in 10 mL PBS supplemented with arabinose (1 mM), FeSO$_4$ (80 µM), and glycerol (0.4% final concentration). This 10 mL volume was split equally between two serum bottles and sealed with butyl rubber stoppers. A volume of 60 mL of air was injected through the stopper of one serum bottle, while 60 mL of methane was injected through the stopper of the other serum bottle. All serum bottles were placed at 37° C., shaking at 280 rpm. After 44 hours, the bottles were opened and sampled for the presence of methanol, using the technique described herein. By comparison with a standard curve, the strains produced the following concentration of methanol as shown in the table below.

TABLE 9

M. capsulatus sMMO is functional in E. coli when co-expressed with many groES/groEL chaperone homologs

| sMMO organsim | sMMO plasmid | groESL organism | groESL plasmid | Methanol (mM) |
| --- | --- | --- | --- | --- |
| M. capsulatus | pDG6 | T. butanivorans | pNH178 | 0.10 |
| M. capsulatus | pDG6 | M. capsulatus | pNH180 | 2.67 |
| M. capsulatus | pDG6 | M. trichosporium | pNH181 | 1.49 |
| M. capsulatus | pDG6 | Methylocaldum sp. 175 | pNH185 | 2.65 |
| M. capsulatus | pDG6 | Methylocystis sp. LW5 | pNH187 | 1.09 |
| M. capsulatus | pDG6 | none | pCDF1b | 0.00 |

Example 10. Several Heterologous Chaperones Improve Ethane into Ethanol Conversion by sMMO This example describes the ability of the sMMO from Solimonas aquatica to have improved activity against ethane as a substrate with the coexpression of a panel of groES/groEL chaperones.

The strain NH283, described elsewhere herein, was transformed with two plasmids simultaneously: pNH160 (SEQ ID NO: 33, containing the coding regions corresponding to the S. aquatica mmoX, mmoY, mmoZ, mmoB, mmoC, and mmoD genes) and one plasmid selected from the set of plasmids containing pNH188 (SEQ ID NO:44), pNH180 (SEQ ID NO:40), pNH185 (SEQ ID NO:42), pNH187 (SEQ ID NO:43), and pCDF1b (SEQ ID NO:20) (containing codon-optimized groES/groEL genes from the microorganisms S. aquatica, M. capsulatus, Methylocaldum sp. 175, Methylocystis sp. LW5, respectively, and a control vector pCDF1b). These transformants were selected on LB agar plates supplemented with kanamycin (50 µg/mL) and spectinomycin (100 µg/mL).

One colony of each of these transformations was selected for growth in 2 mL liquid LB media supplemented with antibiotics, as above, and incubated at 37° C., shaking at 280 rpm. After 16 hours, 1 mL of the culture was added to 10 mL of LB supplemented with kanamycin (50 µg/mL) and spectinomycin (100 µg/mL) and arabinose (1 mM) and FeSO$_4$ (80 µM) to induce the expression of the monooxygenase. Each 10 mL culture was incubated at 37° C., shaking at 280 rpm. After 4 hours, each culture was centrifuged and resuspended in 10 mL PBS to wash the cells. These were each centrifuged again and resuspended in 10 mL PBS supplemented with arabinose (1 mM), FeSO$_4$ (80 µM), and glycerol (0.4% final concentration). This 10 mL volume was split equally between two serum bottles and sealed with butyl rubber stoppers. A volume of 60 mL of air was injected through the stopper of one serum bottle, while 60 mL of ethane was injected through the stopper of the other serum bottle. All serum bottles were placed at 37° C., shaking at 280 rpm. After 24 hours, the bottles were opened and samples for the presence of ethanol, using the technique described herein. By comparison with a standard curve, the strains produced the following concentration of ethanol as shown in the table below.

TABLE 10

S. aquatica ethane monooxygenase is functional in E. coli with many groES/groEL pairs

| sMMO organsim | sMMO plasmid | groESL organism | groESL plasmid | Ethanol (mM) |
| --- | --- | --- | --- | --- |
| S. aquatica | pNH160 | S. aquatica | pNH188 | 0.52 |
| S. aquatica | pNH160 | M. capsulatus | pNH180 | 0.17 |
| S. aquatica | pNH160 | Methylocaldum sp. 175 | pNH185 | 0.33 |
| S. aquatica | pNH160 | Methylocystis sp. LW5 | pNH187 | 0.08 |
| S. aquatica | pNH160 | none | pCDF1b | 0 |

These results demonstrate the wide range of groES/groEL sequences capable of improving functionality of the sMMO, even when the sMMO and groES/groEL microorganisms are distantly-related.

Example 11. Distantly-Related Diiron Monooxygenases are Capable of Converting Ethane into Ethanol This example describes functional diiron monooxygenases expressed in E. coli, converting ethane into ethanol. Pseudonocardia sp. TY-7 prm1A and Solimonas aquatica mmoX are 31% identical at the amino acid level.

The strain NH283, described elsewhere herein, was transformed with two plasmids simultaneously: pNH100 (SEQ ID NO:28, containing the coding regions corresponding to the Pseudonocardia sp. TY-7 propane monooxygenase genes) and pNH177 (SEQ ID NO:38, containing codon-optimized groES/groEL genes from the microorganism Pseudonocardia autotrophica). The strain containing the S. aquatica monooxygenase and S. aquatica groES/groEL was constructed as described elsewhere herein. These transformants were selected on LB agar plates supplemented with kanamycin (50 µg/mL) and spectinomycin (100 µg/mL).

The method for culturing these strains and for measuring the ethanol concentration has been described in the prior example. The results of this measurement are shown in Table 11.

TABLE 11

Comparison of ethane to ethanol conversion with distantly-related ethane monooxygenase enzymes

| sMMO organism | plasmid | groESL organism | plasmid | Ethanol (mM) |
| --- | --- | --- | --- | --- |
| Pseudonocardia sp. TY-7 | pNH100 | P. autotrophica | pNH177 | 0.08 |
| S. aquatica | pNH160 | S. aquatica | pNH188 | 0.52 |

Example 12. Mutations in Soluble Methane Monooxygenase that Improve Function in E. coli This example describes finding mutations that improve the function of sMMO in E. coli. The process for improving sMMO involves three steps: generating genetic diversity, screening the diversified library of clones to identify beneficial or neutral mutations, and recombining these mutations in a new library. This process is iterative and can begin with any functional enzyme sequence for which a screen exists.

Genetic diversity can be generated by well-known techniques, such as error-prone PCR and site saturation mutagenesis. Screening these mutated clones for improved function, using for example the screens described in the examples above, separates clones that have improved or neutral function. (Other screens may also be useful in order to identify, perhaps indirectly, improved enzymes.) These clones can be sequenced in order to identify the mutation(s) connected to the improved function. Recombining mutations can be done using one of several possible methods, such as T-PCR, SOEing PCR, gene shuffling, and commercially available kits like Quikchange Multisite Mutagenesis. These recombined libraries can be tested for improved variants using a range of screens or selections tied to features of the enzyme which one is attempting to alter, such as activity or substrate specificity.

Example 13. MMO Mutations Improving Activity and Specificity in E. coli

This example describes the directed evolution of MMO and the identification of sites and mutations that are important for MMO activity and substrate specificity for ethane and methane. Enzyme specificity, solubility, folding, and activity can all be improved by altering the structure of the protein using site-directed or random mutagenesis. Various MMO libraries were constructed by random error-prone PCR and site-directed mutagenesis. Libraries were first screened in 96-well plates using surrogate substrates to identify primary hits. The highest hits from each plate were validated for conversion of ethane to ethanol in 125 mL glass bottles. Approximately one third of the hits from the primary screening showed improved oxidation of ethane to ethanol during validation. One mmoX mutation conferring ethane specificity was identified; there was an amino acid substitution of N for E at amino acid position 240 in mmoX (SEQ ID NO:10) in this plasmid, which was subsequently named pBZ15 (SEQ ID NO:16). The mutant strain (BZ27) and wild type strain (BZ25) were assayed for ethane and methane oxidation as described elsewhere herein.

TABLE 12

Methane and ethane oxidation by BZ25 and BZ27. Mutation mmoX (E240N) improves activity against ethane compared to wild-type.

| Strain | mmoX mutation | Methanol (mM)/OD600 | Ethanol (mM)/OD600 |
|---|---|---|---|
| BZ25 | Wild type | 5.45 | 0.94 |
| BZ27 | E240N | 2.67 | 1.61 |

This example also demonstrates directed evolution by generating and screening enzyme diversity in iterative rounds, similar to how natural selection operates in evolution. Beneficial mutations at amino acid position 61 and 421 in mmoX were further mutagenized and combined. The identified mmoX variants showing improvement in ethane oxidation activity over E240N (BZ27) are shown in Table 13. The combination of pBZ13 (SEQ ID NO:15) and the E240N mutation in mmoX resulted in nearly an order of magnitude improvement over DG80 expressing wild type mmoX in the presence of pNH180 (SEQ ID NO:40).

TABLE 13

Mutations in mmoX improve conversion of ethane to ethanol

| Strain | mmoX mutations | Ethanol (mM)/OD600 |
|---|---|---|
| DG80 | Wild type | 0.04 |
| BZ27 | E240N | 0.32 |
| BZ45 | K61Y, E240N, S421A | 0.47 |
| BZ46 | K61S, E240N, S421T | 0.45 |

The MMO plasmid in BZ46 carrying three mutations in mmoX (K61S, E240N, S421T) was subjected to another round of mutagenesis and selection, resulting in further improvement in MMO activity (Table 14). Mutations in mmoY (L67M) and mmoC (P167T) are proven beneficial, pointing to the importance of both positions. The MMO plasmid in BZ67, subsequently named pBZ23 (SEQ ID NO:18), is being used as a template for more iterative rounds of mutagenesis and selection.

TABLE 14

Mutations in multiple subunits of MMO improve conversion of ethane to ethanol

| Strains | MMO mutations | | | Ethanol (mM)/OD600 |
|---|---|---|---|---|
| | mmoX | mmoY | mmoC | |
| BZ46 | K61S, E240N, S241T | Wild type | Wild type | 0.60 |
| BZ56 | K61S, E240N, S241T | L67M | Wild type | 0.96 |
| BZ67 | K61S, E240N, S241T | L67M | P167T | 1.16 |

Example 14. Hybrid Monooxygenases in E. coli

The sequences of closely related soluble diiron monoxygenases (SDIMOs) can be a source of genetic diversity that can be recombined to identify improved enzymes. In the case of a multi-subunit enzyme, such as the SDIMOs, one method to improve the enzyme complex is to combine subunits from one SDIMO with those from another. In the simplest example, a single subunit from one SDIMO would replace the homologous subunit from the second. A more complicated scheme would exchange more than one subunit. An even-more complicated scheme would clone, into a single library, all the subunits from multiple homologous SDIMOs in a manner that allows for all possible combinations allowing for exactly one of each subunit. Methods for cloning such a library have been described in the literature, such as Golden Gate Assembly (Engler and Marillonnet, Combinatorial DNA assembly using Golden Gate cloning, *Methods Molecular Biology*, vol 1073, p. 141-156, 2013) and Gibson assembly (D. Gibson et al., *Enzymatic assembly of DNA molecules up to several hundred kilobases,* NATURE METHODS Vol 6, Issue 5, p. 343-345, 2009). These constructs can then be screened using, for example, the assays described herein.

Example 15. Connecting Product of Monooxygenase to Other Metabolic Pathways: In a Single Cell This example describes the expression of a monooxygenase enzyme in a cell that additionally comprises metabolic pathways to consume the product of the monooxygenase reaction and/or to produce the substrate of the monooxygenase reaction, thus connecting the monooxygenase enzyme into a metabolic pathway in the cell.

The cells and methods for constructing those cells containing a monooxygenase enzyme have been described herein. These monooxygenase enzymes and the nucleic acids from which they are expressed are modular components that can be added to cells with metabolic pathways to, for example, consume the product of the monooxygenase reaction. These metabolic pathways may be endogenous to the naturally occurring strain or they may be heterologously expressed from engineered nucleic acids that have been added to the cell.

In one example, the sMMO enzyme is expressed in *P. pastoris*. This strain is cultured in minimal media with methane as the only carbon source. The monooxygenase can oxidize the methane to methanol. *P. pastoris* endogenously contains a pathway to consume methanol. The net result is a strain capable of converting methane into methanol via heterologously expressed sMMO, and subsequently methanol into other metabolites, using enzymatic pathways endogenous to *P. pastoris*.

In a similar example, the sMMO enzyme is expressed in an engineered *E. coli* strain. *E. coli* does not naturally consume methanol, but if this engineered *E. coli* strain is expressing a pathway to consume methanol, then a similar metabolic pathway will function. This strain is cultured in minimal media containing methane, and a similar pathway is operational in this *E. coli* strain.

Given the many substrates and products of sMMO (in Table 1), it is not difficult to imagine many other metabolic pathways that could be connected to/by the sMMO enzyme. Identifying all possible metabolic pathways that could be constructed using sMMO as a possible chemical reaction (i.e. a "link between nodes" of metabolites) is a task suitable for a computer.

Example 16. Connecting Product of Monooxygenase to Other Metabolic Pathways: More than One Cell This example describes the expression of a monooxygenase enzyme in a biological system of multiple cell types that additionally comprises metabolic pathways to consume the product of the monooxygenase reaction and/or to produce the substrate of the monooxygenase reaction, thus connecting the monooxygenase enzyme into a metabolic pathway in the biological system.

The cells and methods for constructing those cells containing a monooxygenase enzyme have been described herein. In a conceptually similar manner to the example setting forth the connection of a metabolic pathway in a single cell, the metabolites involved in a metabolic pathway can be converted by enzymes in a single cell or in multiple cell types in a culture (i.e. a "co-culture") or in a co-culture wherein some of the enzymatic steps occur outside of any cells, in the fermentation broth.

The method of co-culturing multiple strains in a single fermentation is straightforward. The strains can be grown up separately and combined in a single fermentation vessel. In one instance, an *E. coli* strain expressing the sMMO is co-cultured with a methylotrophic strain, such as *P. pastoris*. This fermentation can be performed in minimal media lacking a carbon source. When the strains are sealed in a fermentation vessel, methane can be added to the vessel. The sMMO in *E. coli* will convert the methane into methanol, which can diffuse out of the *E. coli* cell and enter the *P. pastoris* cell where it can be consumed and converted into intracellular metabolites and/or used as a carbon source for growth. If the *P. pastoris* strain is engineered to produce a chemical, the *E. coli* strain is simply biologically converting the methane into methanol for use as a substrate in a metabolic pathway inside the co-cultured yeast strain.

This example is not meant to be limiting to methane-fed fermentations, as the concept is extensible to the biological conversion of many substrates (e.g. those shown in Table 1) into many products that can be used by natural or engineered microorganisms of a similar or different species. There is no reason, in principle, that the entire metabolic pathway from feedstock to product must reside in a single cell as long as the metabolite(s) being exchanged can diffuse from one cell to another. If metabolite(s) are unable to naturally diffuse in or out of a cell, the expression of a transporter or porin protein may enable active or passive transport of the metabolite in or out of a cell. Many examples of metabolite-specific or general transporters or porins are known.

Example 17. Improved Aerobic Growth on Ethanol as a Major or Sole Carbon Source in *E. coli*

Strains of *E. coli* capable of aerobic growth on ethanol have been previously reported (D Clark & J E Cronan, *Escherichia coli mutants with dehydrogenase and nitrate Escherichia coli Mutants with Altered Control of Alcohol Dehydrogenase and Nitrate Reductase*, 141 177-183, 1980); (J Membrillo-Hernández et al., *Evolution of the adhE gene product of Escherichia coli from a functional reductase to a dehydrogenase: Genetic and biochemical studies of the mutant proteins*, 275 Journal of Biological Chemistry 33869-33875, 2000).

The growth rate of *E. coli* on minimal ethanol media depends on the rate of assimilation of ethanol (FIG. 1). Thus, strains may be engineered or evolved to increase the rate of growth on minimal ethanol media. Many strategies may be employed to improve the growth rate on ethanol, such as (but not limited to) chemical mutagenesis, overexpression of targeted genes in the pathway (e.g. alcohol-aldehyde dehydrogenase, glyoxylate shunt enzymes), overexpression libraries/transduction from strains with faster growth on ethanol or acetate.

In order to improve the growth rate of *E. coli* on ethanol as a major or sole carbon source, an expression library of the adhE(A267T, E568K) (SEQ ID NO:49) mutant was constructed.

The plasmid-based expression library of the adhE(A267T, E568K) mutant was constructed by first generating pNH045 (SEQ ID NO:73), using standard molecular biology methods. The adhE gene was amplified by colony PCR from genomic DNA prepared from *E. coli* NEB Turbo. Primers were designed to introduce the two desired mutations and the parts were assembled using the Gibson assembly technique (D G Gibson et al., *Enzymatic assembly of DNA molecules up to several hundred kilobases*, 6 Nature methods 343-345, 2009) into the plasmid pMAL-c5x from New England Biolabs. This plasmid contains an IPTG-inducible Ptac promoter. Successful transformants were screened by colony PCR and sequenced using Sanger sequencing. One clone, with the correct sequence through the promoter, open reading frame, and terminator, was named pNH045.

In order to vary the promoter strength, a PCR was performed using pNH045 as the template. Degenerate primers were used with degenerate bases and non-standard bases (see for example, https://www.idtdna.com/pages/docs/quick-looks/quick-look---degenerate-sequences-and-non-standard-bases.pdf?sfvrsn=1). The two primers that were used to introduce variation at the key promoter nucleotides in the sequence are shown below:

Ptac library fwd=gctgttSaMaattaatcatcggctcgKaHRatgtgtgg aattgtgagcggataac
Ptac library rev=catYDtMcgagccgatgattaattKtSaacagctcatt tcagaatatttgccagaacc This PCR was performed such that the reaction generated a DNA fragment that could be self-ligated using the Gibson protocol. This reaction was purified and transformed into the desired strain of E. coli, NEB Turbo. Several of these clones were sequence verified to contain a variable sequence in the promoter region. The colonies were scraped from the agar plate and combined in a single DNA library by miniprep extraction, and named pNH069L.

The identification of an optimal expression level of adhE (A267T, E568K) for growth on ethanol as a major or sole carbon and energy source is a straightforward growth competition. The plasmid library pNH069L was transformed into an E. coli strain of interest (e.g. BL21) by electroporation. These cells were scraped from the agar plate the following day and grown in a minimal media with ethanol as the sole carbon source at the desired temperature (e.g. 37° C.) under inducing conditions (e.g. with IPTG at a saturating final concentration of 1 mM). Minimal ethanol media may contain the standard M9 salts recipe plus thiamine and ethanol at 1% final concentration, though other minimal media recipes also have been described (J Tamarit, *Identification of the Major Oxidatively Damaged Proteins in Escherichia coli Cells Exposed to Oxidative Stress*, 273 Journal of Biological Chemistry 3027-3032, 1998). Passaging these cells through this media allowed the fastest growing strains to dominate the population of the culture. This culture was then streaked on rich media (LB+carbenicillin antibiotic at 100 µg/mL) to isolate single clones. Each of these was then grown in minimal ethanol media to compare the growth rate against the growth on minimal glucose media and against a control strain (e.g. DC272) (J Membrillo-Hernández et al., *Evolution of the adhE gene product of Escherichia coli from a functional reductase to a dehydrogenase: Genetic and biochemical studies of the mutant proteins*, 275 Journal of Biological Chemistry 33869-33875, 2000)

Example 18. Improved Growth on Ethanol in E. coli

This example describes a series of gene over-expressions which allow E. coli to grow robustly across many concentrations of ethanol. These genes are either from heterologous organisms or from E. coli.

Previous work has shown that introducing two point mutations in E. coli adhE—A267T and E568K (SEQ ID NO:49)—is sufficient to allow E. coli to grow on ethanol. AdhE is a bifunctional enzyme that can act as both an alcohol dehydrogenase (ADH) and an acetaldehyde dehydrogenase (ACDH). Based on our own work and also published characterization of this enzyme, we determined that the ADH activity of adhE (A267T, E568K) could be limiting for applications where the concentration of ethanol is low, because it has a high $K_M$ for ethanol.

We searched for new enzyme pathways that have high activity at low ethanol concentrations. We identified a panel of ADH and ACDH enzymes from organisms that naturally grow on ethanol, and synthesized codon-optimized versions of the relevant genes. We also included genes from E. coli that have been shown to perform the desired chemistries. Operons of all possible two-gene combinations were constructed using Gibson assembly into a pBR322-origin plasmid under control of a Ptac promoter, and the expression levels of these genes were simultaneously varied using degenerate bases in the ribosome binding sites. Some strains combined adhE (A267T, E568K) expressed from the genome with single ADH genes overexpressed from the plasmid. The resulting colonies were screened for growth across a wide range of ethanol concentrations. The optical density was measured 20 hours after cells were inoculated into minimal ethanol media. Table 15 shows the results. The wild-type E. coli does not grow on ethanol at any concentration, and different combinations of ADH's and ACDH's confer different magnitudes of growth benefit.

The following describes the method for culturing the strains and measuring the growth of the strains on ethanol. The strains were cultured in LB broth supplemented with carbenicillin (100 µg/mL) for an overnight growth at 37° C., and then washed by spinning the culture down and washing two times in phosphate buffered saline media (PBS). Minimal media BEM0 was formulated as follows. First a 1000× metals solution was mixed containing the following compounds in the concentrations provided: 0.1 M $FeCl_3 * 6H_2O$, 1 M $CaCl_2$, 1 M $MnCl_2 * 4H_2O$, 1 M $ZnSO_4 * 7H_2O$, 0.2 M $CoCl_2 * 6H_2O$, 0.2 M $NiCl_2 * H_2O$, 0.1 M $NaMoO_4 * 2\ H_2O$, 0.1 M $Na_2SeO_3 * 5\ H_2O$, 0.1 M $H_3BO_3$. The minimal media called BEM0 contains (in $ddH_2O$): 25 mM $(NH_4)_2SO_4$, 50 mM $KH_2PO_4$, 50 mM $Na_2HPO_4$, 1 mM $MgSO_4$, 0.15% LB, 1 mM IPTG, and 0.1% of the 1000× metals solution, plus a desired concentration of ethanol. The cells were then resuspended in minimal BEM0 media with different concentrations of ethanol to a starting OD600 of 0.1. These cultures were aliquoted to 96-well plates, sealed, and shaken overnight at 37° C. for 20 hours. 100 µL media was sampled and an absorbance at 600 nm was taken.

TABLE 15

Improved ethanol assimilation pathways allows faster growth across a wide range of ethanol concentrations. Data are averages of measurements made from two independent cultures.

| Base strain | change | ADH | ACDH | OD600 at each [Ethanol] | | | |
|---|---|---|---|---|---|---|---|
| | | | | 0% | 0.03% | 0.06% | 0.13% |
| WT E. coli | none | | | 0.11 | 0.11 | 0.10 | 0.10 |
| LC55 | genomic adhE (A267T, E568K) | | | 0.12 | 0.12 | 0.12 | 0.59 |

TABLE 15-continued

Improved ethanol assimilation pathways allows faster growth across a wide range of ethanol concentrations. Data are averages of measurements made from two independent cultures.

| | Base strain change | ADH | ACDH | OD600 at each [Ethanol] | | | |
|---|---|---|---|---|---|---|---|
| | | | | 0% | 0.03% | 0.06% | 0.13% |
| LC253 | genomic adhE (A267T, E568K) | adh (B. stearothermophilus) | | 0.11 | 0.13 | 0.23 | 0.83 |
| LC294 | none | adh (B. stearothermophilus) | mhpF (E. coli) | 0.12 | 0.14 | 0.23 | 0.30 |
| LC292 | none | adh (B. stearothermophilus) | acdH (Clostridium kluyveri) | 0.10 | 0.23 | 0.51 | 0.85 |

Plasmid pLC99 (SEQ ID NO:27) was isolated by miniprep from LC292. Another clone with similar growth phenotype was isolated and its plasmid was named pLC100 (SEQ ID NO:23). Both plasmids were subsequently used in follow-up experiments to confer improved ethanol assimilation properties on E. coli strains.

Example 19. Synthetic Ethanotroph in E. coli

This example provides a description of a strain of E. coli capable of growth on ethane as a major or sole carbon source.

Since E. coli strains have been described here and elsewhere (D Clark & J E Cronan, *Escherichia coli mutants with dehydrogenase and nitrate Escherichia coli Mutants with Altered Control of Alcohol Dehydrogenase and Nitrate Reductase*, 141 177-183, 1980) and (J Membrillo-Hernández et al., *Evolution of the adhE gene product of Escherichia coli from a functional reductase to a dehydrogenase: Genetic and biochemical studies of the mutant proteins*, 275 Journal of Biological Chemistry 33869-33875, 2000) that are able to grow on ethanol as a major or sole carbon and energy source, these strains can be the basis for a strain capable of growth on ethane, provided a functional enzyme or enzyme complex can be expressed that can convert ethane into ethanol.

Enzymes exist that are capable of converting a hydrocarbon or an alkane into an alcohol. These enzymes classes include the soluble methane monooxygenases (sMMOs), particulate methane monooxygenases, hybrid methane monooxygenases, alkane/alkene monooxygenases, toluene monooxygenases, some ammonium monooxygenases, and some P450 monooxygenases. To date, however, there are no reports of any group describing the successful, functional expression of a monooxygenase enzyme in E. coli capable of oxidizing ethane into ethanol.

These enzymes can be expressed, along with any accessory proteins, protein folding chaperones, and/or electron donation mediators/reductases, using standard molecular biology techniques. The genes can be expressed from DNA extracted from the native organism and cloned into expression vectors suitable for E. coli. These vectors can be transformed into E. coli, using standard techniques, such as electroporation. Alternatively, DNA can be designed and constructed to allow integration of the genes into the E. coli chromosome, such that expression of the genes would produce the desired protein components. Another option is to synthesize the genes, using vendors such as IDT or DNA2.0, and express the genes from either a plasmid or a chromosomal locus. Synthesized DNA allows the researcher to choose the desired codon at each position along the gene and can be used to optimize the nucleic acid sequence for expression. Synthesized DNA also allows the choice of nucleic acid sequences between genes in a polycistronic operon. These genes or operons can be expressed from any promoter that is functional in E. coli, including the most well-studied promoters, such as Ptac, Plac, Ptrc, Pbad (which are inducible) and PT5 (which is constitutive).

These monooxygenase enzyme complexes can be expressed in E. coli. Examples of monooxygenases that may oxidize ethane to ethanol are given in Table 1. This set of monooxygenases is not meant to be limiting but just as an example of a set that could be able to oxidize ethane to ethanol. It is clear that by a simple BLAST search (S Altschul et al., *Basic Local Alignment Search Tool*, 215 J Mol Biol. 403-410, 1990), one could identify alternative monooxygenases that are closely related to the set listed in Table 16.

TABLE 16

Examples of monooxygenase enzymes that may oxidize ethane

| Organism | Gene names | Accession number |
|---|---|---|
| Pseudomonas mendocina KR1 | tmoABCDEF | AY552601.1 |
| Methylocella silvestris BL2 | Msil1651-1647 | NC_011666.1 |
| Mycobacterium NBB4 | smoXYC1B1Z, groL (Mycch_5901 - Mycch_5897, Mycch_5390) | CP003054.1 |

TABLE 16-continued

Examples of monooxygenase enzymes that may oxidize ethane

| Organism | Gene names | Accession number |
| --- | --- | --- |
| Thauera butanivorans | bmoXYBZDC | AAM19732.1, AAM19731.1, AAM19730.1, AAM19729.1, AAM19728.1, AAM19727.1, ABU68845.2 |
| Mycobacterium smegmatis mc2-155 | mimABCD | CP000480.1 |
| Gordonia TY-5 | prmABCDG | AB112920.1 |
| Pseudonocardia autotrophica | WP_037052656.1 to WP_037052662.1 | NZ_JNYD01000036.1 |
| Amycolatopsis methanolica 239 | AMETH_2368-2375 | CP009110.1 |
| Mycobacterium HXN-1500 | CYP153A6 (ahpGHI) | AJ783967.1 |
| Bacillus megaterium | P450-BM3 | WP_034650526.1 |
| Pseudomonas putida | P450cam | WP_032492633.1 |
| Methylocella silvestris BL2 | mmoXYBZDC (Msil1262 - Msil1267) | NC_011666.1 |
| Methylococcus capsulatus (Bath) | mmoXYBZDC_G | AF525283.1, M90050.3 |
| Methylosinus trichosporium OB3b | mmoXYBZDC, groEL | X55394.3, EF685207.1 |
| Methylococcus capsulatus (Bath) | pmoCAB | L40804.2 |
| Methylosinus trichosporium OB3b | pmoCAB | U31650.2 |
| Pseudomonas putida (OCT plasmid) | alkBFGHJKLNST | NG_035191.1 |
| Rhodococcus corallinus B-276 | amoABCD | D37875.1 |

The fusion monooxygenase spmoB (R Balasubramanian et al., Oxidation of methane by a biological dicopper centre., 465 Nature 115-119, 2010) contains two fused domains of the pMMO complex from Methylococcus capsulatus (Bath). It was demonstrated that spmoB was not soluble when expressed in E. coli, but that it could be extracted and resolubilized in vitro in a method that demonstrated some functionality at oxidizing methane. This spmoB enzyme may be expressed in E. coli strains that are simultaneously expressing protein-folding chaperones, such as groES/groEL from E. coli or from the native organism M. capsulatus. spmoB can also be expressed from a construct that targets the enzyme to the periplasmic space, between the inner and outer plasma membranes of E. coli. Since the spmoB enzyme is a fusion of domains that were both taken from the periplasmic part of the pmoB protein, spmoB may function properly in the periplasm. Periplasmic-targeting sequences have been described previously.

The particulate methane monooxygenase (pMMO) may also oxidize ethane to ethanol in E. coli. This protein complex is composed of three subunits and resides in the inner membrane of the native organism. To successfully express the pMMO in E. coli, correct N-terminal leader sequences must be properly fused to each of the three subunits.

The assay for successful expression of a monooxygenase converting ethane to ethanol may be the growth of the E. coli strain on ethane as a major or sole carbon source. The E. coli host strain may be chosen to be one that can grow on ethanol as a major or sole carbon source, so that any functional ethane monooxygenase that converts ethane to ethanol will be able to provide a carbon-based substrate for the bacterium to grow and reproduce. The minimal salts media provides the necessary nutrients, other than the carbon source, to sustain the bacterium. Minimal salts media for E. coli can be based on the M9 recipe, widely used in microbiology, along with the necessary minerals, such as iron or copper, that may be required for the functionality of the monooxygenase. The media and the strain containing the monooxygenase, or a library of monooxygenases, can be inoculated into a sterile bottle and sealed using, for example, a butyl rubber stopper. Then, using a syringe and needle, ethane gas can be injected into the headspace above the culture. This sealed bottle can be incubated for a prolonged period to allow the ethane to dissolve into the media and for the cells to consume the ethane and grow. Growth can be measured either by an increase in optical density of the culture, relative to a control into which no ethane has been injected, or by counting the colony forming units for both the experiment and control.

In some cases, the rate of ethanol production via oxidation of ethane will be too slow for the strain to grow. Strains may then be grown in a media containing a limiting concentration of ethanol for a moderate growth rate—still limited by the amount of carbon available. Any cell that contains a functional monooxygenase that is making even small amounts of ethanol will have a growth advantage, since carbon is the limiting element for growth in this experimental design. These cultures may be grown continuously, as in bioreactors, turbidostats, or chemostats, or they may be serially passaged from one bottle to the next, so as to allow growth over a longer period of time. The exponential rate of the growth of microbial cells is a key advantage of this strategy.

The following describes the actual work performed to demonstrate a synthetic ethanotroph in E. coli, Specifically, this part of the example describes the construction and testing of a strain containing a functional sMMO and an ethanol-assimilation pathway, capable of growth on ethane as a major or sole carbon source.

Strain Construction of NH566

The strain NH566 was constructed in the following series of steps. The plasmid pBZ15 (SEQ ID NO: 16) was constructed as described elsewhere herein. The plasmid pNH225 (SEQ ID NO: 45) was cloned by adding a DNA fragment from pLC99 (SEQ ID NO: 27) encoding lacI-Ptrc-adh(*B. stearothermophilus*)-acdH(*C. kluyveri*) ethanol-assimilation pathway into pBZ13, which contains expression cassettes for the groES/groEL from *E. coli* and for the groES/groEL from *M. capsulatus*. Strain NH283 was constructed, as described above. NH566 was selected from transformants of NH283 transformed with both plasmids pBZ15 (SEQ ID NO: 16) and pNH225 (SEQ ID NO: 45).

Culturing NH566 with Ethane Vs Air

NH566 was streaked onto LB agar plates supplemented with spectinomycin (100 μg/mL) and kanamycin (50 μg/mL) and incubated at room temperature for 3 days. A single colony was picked into 1 mL liquid LB broth supplemented with spectinomycin (100 μg/mL) and kanamycin (50 μg/mL) and grown at 37° C., shaking at 280 rpm. After 4 hours, the 1 mL was added to 9 mL of the same media and grown at 37° C., 280 rpm for another 2 hours. This 10 mL culture was centrifuged and washed in 10 mL PBS once. From this, 1 mL of the PBS was centrifuged again and resuspended in 10 mL of BEM4 media supplemented with ethanol to a final concentration of 0.5% (v/v). This culture was placed at 37° C., shaking at 280 rpm for 23 hours. From this culture, 5 mL was centrifuged and the supernatant was discarded. The pellet was resuspended in 10 mL PBS to wash. The resuspension was centrifuged again, the supernatant was discarded and the pellet was resuspended in 10 mL BEM4 base media lacking any ethanol. (The minimal media called BEM4 contains (in ddH$_2$O): 50 mM KH$_2$PO$_4$, 50 mM Na$_2$HPO$_4$*7 H$_2$O, 1 mM MgSO$_4$, 0.15% LB, 6.25 mM glutamine, 80 μM FeSO$_4$, 0.1 mM CaCl$_2$, 1 mM IPTG, 0.1% of the 1000× metals solution, and 1 mM arabinose (where required for induction of promoter pBAD), plus a desired concentration of ethanol.) From this culture, 4.5 mL was pipetted into each of two serum bottles and sealed with butyl rubber stoppers. The initial cell density was measured by OD600 and found to be approximately 0.5 as desired. Into one serum bottle, a syringe was used to inject 60 mL of air, while into the other serum bottle, a syringe was used to inject 60 mL of ethane. The serum bottles were incubated at 37° C., shaking at 280 rpm. After 20 hr, 46 hr, and 64 hr of incubation, both serum bottles were sampled through the rubber stoppers using a small syringe. The cell density of both samples was measured by OD600 and by plating on LB agar plates overnight for colony counting. FIG. 7 shows a timecourse of the OD600 measurements for the two serum bottles which demonstrates that the ethane-fed culture grows to a higher OD600 than its starting density, while the air-fed culture drops in density, due to a loss in cell viability. The increase in cell density due to the presence of the ethane in the serum bottle confirms that the cells are able to metabolize the ethane. Cell viability increases due to ethane were confirmed by counting the colony forming units on the agar plates from the 46 hr and 64 hr timepoints. At 46 hrs, there were 1.44× more colonies from the ethane-fed culture over the air-fed culture. By 64 hrs, this ratio had increased to 1.75×.

Example 20. Bioconversion of Ethanol to Free Fatty Acids in *E. coli*

This example describes potential pathways to increase production of fatty acids in *E. coli* from ethanol as a feedstock. This example also describes work performed that increased the production of fatty acids in *E. coli* from ethanol.

Previous work has demonstrated the ability to overproduce fatty acids and derivatives from *E. coli*, using glucose or other sugar mixtures as the feedstock (H Cho & J. E. Cronan, *Defective Export Of A Periplasmic Enzyme Disrupts Regulation Of Fatty Acid Synthesis*, Journal of Biological Chemistry 270 4216-4219). Sugars are metabolized into acetyl-CoA as a central node of metabolism, and acetyl-CoA is used by the cell to produce fatty acids using the fatty acid biosynthesis pathway.

Previous work has also shown that *E. coli* mutants can be isolated with the ability to consume ethanol as a major or sole carbon and energy source, under aerobic conditions (D Clark & J E Cronan, *Escherichia coli mutants with dehydrogenase and nitrate Escherichia coli Mutants with Altered Control of Alcohol Dehydrogenase and Nitrate Reductase*, 141 177-183, 1980). In some cases, this ability was traced back to the overexpression of the native *E. coli* gene adhE, while, in other cases, mutations were discovered in the adhE gene that seemed to further enhance the growth rate of *E. coli* on ethanol (J Membrillo-Hernández et al., *Evolution of the adhE gene product of Escherichia coli from a functional reductase to a dehydrogenase: Genetic and biochemical studies of the mutant proteins*, 275 Journal of Biological Chemistry 33869-33875, 2000) The adhE gene encodes aldehyde-alcohol dehydrogenase, which has both alcohol dehydrogenase and coenzyme A-dependent acetaldehyde dehydrogenase activity.

In order to generate a strain of *E. coli* that can convert ethanol into fatty acids under aerobic culturing conditions, the adhE gene (or a mutant thereof, such as adhE(A267T, E568K)) may be overexpressed from a plasmid or chromosomal locus. Standard methods for expression libraries in *E. coli* have been described that involve the cloning of the gene with a degenerate oligonucleotide to randomize the base pairs at critical locations, inside, for instance, the ribosomal binding site or the promoter. Such a library may be used to create a diverse set of *E. coli* strains that vary in their expression levels of adhE. Since the object is to identify the strain that can grow fastest on ethanol as a major or sole carbon source, this library of *E. coli* can be tested under such conditions, in a single culture. The fastest growing strains will outcompete other strains, will become the most common genotype in the mixed population, and can be isolated by standard microbiology methods, and retested as clonal populations against each other. Using this technique, optimal levels of adhE(A267T, E568K) expression have been identified in *E. coli* strains such as NEB Turbo, BL21(DE3), and EPI300.

The production of fatty acids from glucose or other sugar mixtures in *E. coli* has been shown elsewhere (H Cho & J E Cronan, *Defective Export Of A Periplasmic Enzyme Disrupts Regulation Of Fatty Acid Synthesis*, Journal of Biological Chemistry 270 4216-4219). A thioesterase, such as *E. coli* 'tesA or *U. californica* 'fatB1 (L Yuan et al., *Modification of the substrate specificity of an acyl-acyl carrier protein thioesterase by protein engineering.*, 92 Proceedings of the National Academy of Sciences of the United States of America 10639-10643, 1995), is expressed in *E. coli* from a plasmid or chromosomal locus. This thioesterase hydrolyzes the acyl-ACP bond and releases a fatty acid. An expression library, similar to that described in the previous paragraph, can be used to adjust the expression of the thioesterase to an optimal level under the desired culture conditions.

In order to generate a strain of *E. coli* capable of producing fatty acids from ethanol, an ethanol-consuming strain can be used as a host for a plasmid expressing the thioesterase library. Screening a moderate number of clones, e.g. less than 100, would be sufficient to find a clone with an optimal level of thioesterase expression, under the given culture conditions.

The analytical method for identifying fatty acids from the culture broth has been described previously (S Del Cardayre, US patent no. 20100257778, 2010). In brief, the culture is mixed with an equal volume of an organic solvent, such as butyl acetate, and agitated to enable the fatty acids to separate into the organic layer. The sample is centrifuged to separate the organic layer from the aqueous layer. A small volume of the organic layer can be run on a gas chromatograph to identify the fatty acid peaks.

This part of the example describes work actually performed that increased the production of fatty acids in *E. coli* from ethanol. Strain DC272 was received from the *E. coli* Genetic Stock Center at Yale University. The araBAD operon was deleted using the method of Datsenko and Wanner to create strain LC55 (DC272 araBAD::cat). Synthetic DNA encoding fatB1 from *Umbellularia californica* was codon optimized, purchased from a commercial vendor (Integrated DNA Technologies), and cloned into a plasmid in an operon behind the bla gene (conferring resistance to ampicillin) in a standard cloning vector containing a p15a origin of replication. After the DNA sequence had been verified, the plasmid (named pBZ22, SEQ ID NO: 56) was transformed into LC55, generating strain NH671. As a control, LC55 was transformed with a different plasmid containing the same antibiotic resistance (bla).

The fluorescent Nile Red assay was used to measure the free fatty acid production of NH671 as follows. Both strains (NH671 and control) were inoculated in LB broth supplemented with carbenicillin (100 µg/mL) overnight at 37° C., 280 rpm. After 16 hours, 10 µL of the overnight culture was transferred into 2 mL of BEM0 media (composition described elsewhere herein plus 0.5% final concentration of ethanol) and capped tightly. After two days, the cultures were sampled and the cell densities were normalized. From each culture, a 100 µL sample was taken and mixed with 0.5 µL of Nile Red stock solution (250 mg/mL in DMSO) as described by Hoovers (Hoovers et al., *Bacterial production of free fatty acids from freshwater magroalgal cellulose*, Appl. Microbiol. Biotechnology, Vol. 91(2), 2011). The fluorescence was measured using an excitation wavelength of 485 nm and an emission wavelength of 590 nm.

A blank media control was used to measure the background fluorescence and measured 296 counts. Strain NH671 measured 5950 counts, while the control strain (containing no fatB1 gene) measured 2151. This corresponds to a 2.77-fold higher fluorescence due to the free fatty acids in the sample.

Example 21. Bioconversion of Ethanol to Succinate in *E. coli*

In order to construct strains capable of converting ethanol into succinate, *E. coli* strains were modified by the deletion of iclR and by the reduction or removal of expression of sdhAB, which encodes the succinate dehydrogenase enzyme. This example describes the construction of two strains with the ability to convert ethanol into succinate, along with the method for performing the conversion with the strains.

Strain Construction of NH533 and NH610

A strain capable of producing succinate was generated by deletion of three genetic loci in the *E. coli* strain NEB Express (New England Biolabs), a BL21-derivative. The three loci (araBAD, iclR, and sdhAB) were deleted sequentially using the method of Datsenko and Wanner (2000). Briefly, a deletion cassette was amplified from plasmids pKD3 or pKD13 using primers with homology to the target locus. The strain was made electrocompetent and transformed with the deletion cassette. Strains with the deletion were verified by colony PCR and the markers were removed using pCP20, as described elsewhere, leaving an FRT scar. The resulting strain (NEB Express ΔaraBAD::FRT ΔiclR::FRT ΔsdhAB::FRT) was named LC344. This strain was then transformed with a plasmid that confers improved assimilation of ethanol, pLC100 (SEQ ID NO: 23), and was named NH533.

Strain NH610 was constructed by sequential deletion of araBAD and iclR from NEB Express, as above. To reduce the expression of the sdhAB genes, without completely deleting them, a DNA fragment with homology to the 3' end of the sdhAB operon plus a Ptrc promoter and a chloramphenicol resistance marker was constructed to direct the Ptrc promoter in the opposite direction to the transcription of the sdhAB genes (SEQ ID NO: 47). This DNA cassette was integrated into the strain, using pKD46 as the lambda red system, as described above and elsewhere. Transformants were selected on LB agar plates supplemented with chloramphenicol (17 µg/mL). The resulting strains were then transformed with pLC100 (SEQ ID NO: 23) to improve the ability to assimilate ethanol into central metabolism. NH610 was selected from this transformation as a single clone.

Bioconversion of Ethanol into Succinate with NH533

NH533 was inoculated into 1 mL of LB broth supplemented with carbenicillin (100 µg/mL) directly from a glycerol stock and placed in a shaking incubator at 37° C., 280 rpm overnight. The following morning, the strain was diluted 1:100 into 2 mL of LB broth supplemented with carbenicillin, and grown at 37° C., 280 rpm for 4 hours. After 4 hours, the strain was washed once in 2 mL of PBS and resuspended in 1 mL of PBS+glycerol (0.8% final concentration)+FeSO$_4$ (80 µM)+IPTG (1 mM)+ethanol (0.5% v/v). The tube was capped tightly and placed at 37° C., 280 rpm for 48 hours.

When the bioconversion was complete at 48 hours, the culture was centrifuged at 16 krpm for 2 min and the supernatant was sampled into a separate tube. This sample was used for HPLC analysis of succinate using a Shimadzu 10 AVP equipped with a Phenomenex Synergy Hydro RP 5 µm column, 20 mM KH$_2$PO$_4$ (pH 3) mobile phase, in an isocratic gradient. Succinic acid was detected using a UV detector at 200 nm. The HPLC was calibrated with succinic acid in water at different known concentrations. Using these readings as a standard curve, it was determined that NH533 converted ethanol into 0.5 mg/mL of succinate.

Conversion of Ethanol into Succinate with NH610

Strain NH610 was inoculated into 2 mL of LB broth supplemented with carbenicillin (100 µg/mL) directly from a glycerol stock and placed in a shaking incubator at 37° C., 280 rpm overnight. The following morning, the strain was diluted 1:100 into 2 mL of LB broth supplemented with carbenicillin, and grown at 37° C., 280 rpm for 4 hours. After 4 hours, the strain was washed once in 2 mL of PBS and inoculated with 25 µL into 1 mL of BEM0 media (described elsewhere herein) containing 0.5% final concentration of ethanol. The tube was capped tightly and placed at 37° C., 280 rpm for 48 hours. After 48 hours, the culture was centrifuged at 16 krpm for 2 min and the supernatant was sampled into a separate tube. This sample was used for HPLC analysis of succinate using the method described above. Using a standard curve, it was determined that NH610 converted ethanol into 0.41 mg/mL of succinate.

Example 22. Bioconversion of Ethane to Succinate in E. coli Using a Monoculture

This example describes the conversion of ethane into succinate in a culture of an engineered strain of E. coli. To conclusively demonstrate that the succinate that is produced is derived from the ethane, the experiment was conducted with 13C-labeled ethane and it was observed that a significant fraction of the measured succinate was 13C-labeled.

Strain Construction of NH606

The strain NH606 was constructed by the following steps. First, using the method of Datsenko and Wanner (2000), the genes iclR, sdhAB, and araBAD were sequentially deleted from the E. coli strain NEB Express using FRT-flanked cassettes providing resistance to kanamycin. The antibiotic resistance cassette was removed using pCP20, as described elsewhere, leaving only FRT scars in the three loci. This strain, NH558, was then made electrocompetent and transformed with the plasmids pBZ15 (SEQ ID NO: 16) and pBZ13 (SEQ ID NO: 15), as described herein, and transformants were selected on LB agar plates supplemented with kanamycin (50 μg/mL) and spectinomycin (100 μg/mL). A single colony of NH558 was grown in LB supplemented with the antibiotics, made electrocompetent, and transformed with pLC99 (SEQ ID NO: 27), a plasmid which confers improved ethanol assimilation, as described herein. These transformants were selected on LB agar plates supplemented with kanamycin (25 μg/mL), spectinomycin (50 μg/mL), and carbenicillin (50 μg/mL). One of these colonies was selected for further study and given the name NH606.

Bioconversion of 13C-Ethane into Succinate

The strain NH606 was inoculated into 1 mL of LB supplemented with carbenicillin (50 μg/mL), kanamycin (25 μg/mL), and spectinomycin (50 μg/mL) for 16 hours. A volume of 0.2 mL of the culture was transferred into 1.8 mL of LB media supplemented with the above antibiotics plus 1 mM L-arabinose, 1 mM IPTG, 50 μM ferric citrate, and 200 μM L-cysteine. After 4 hours, the cultures were centrifuged at 4000 rpm for 5 minutes. The supernatant was discarded and the pellet was resuspended in an equal volume of PBS. The samples were centrifuged again and resuspended in BEM6 media to an OD600 of 2.0. (The minimal media called BEM6 contains (in ddH$_2$O): 50 mM KH$_2$PO$_4$, 50 mM Na$_2$HPO$_4$*7 H$_2$O, 1 mM MgSO$_4$, 0.15% LB, 1.5625 mM glutamine, 80 μM FeSO$_4$, 0.1 mM CaCl$_2$, 1 mM IPTG, 0.1% of the 1000× metals solution, and 1 mM L-arabinose (where required for induction of promoter pBAD), plus a desired concentration of ethanol.) From this culture, 500 μL was pipetted into each of two sterile glass vials, each containing a single glass bead to prevent cell clumping. These vials were sealed with rubber stoppers. Using a syringe, 1 mL of 13C-labeled ethane was injected into the headspace above the liquid in one of the vials, while 1 mL of air was injected into the other vial. All vials were placed at 37° C., 280 rpm. After incubating at 37° C. for 46 hours, the samples were centrifuged at 16.1 krpm for 2 min. Each sample was analyzed for 13C-labeled succinic acid by LC/MS/MS and compared to an analytical standard. 60 μL of methanol was mixed with 20 μL of samples and centrifuged. Twenty μL of supernatant was diluted 5× with 12.5% methanol 0.1% formic acid. Calibration standards were prepared by serial dilution of succinate stock solution in 12.5% methanol 0.1% formic acid. Sixty μL of the above sample was mixed with 60 μL of the internal standard solution (2-HG-d3 in 12.5% methanol 0.1% formic acid) prior to the injection to the LC/MS/MS. The HPLC was a Shimadzu LC-20AD with an Agilent Zorbax SB-C18 column (3×100 mm, 3.5 μm). The mobile phases were 0.005% formic acid, 0.5 mM ammonium acetate in water and a mixture of methanol:water (95:5) with 0.5 mM ammonium acetate. The flow rate was 0.5 mL/min and the column was held at room temperature. The mass spectrometry was performed using a AB Sciex API4000 system using turbo ionspray and negative ionization. Succinic acid was detected by measuring the peak heights at m/z values of 117.0 (for 12C-succinic acid), 118.0 (for singly-labeled 13C succinic acid) and 119.0 (for doubly-labeled 13C2-succinic acid).

Figure 8:
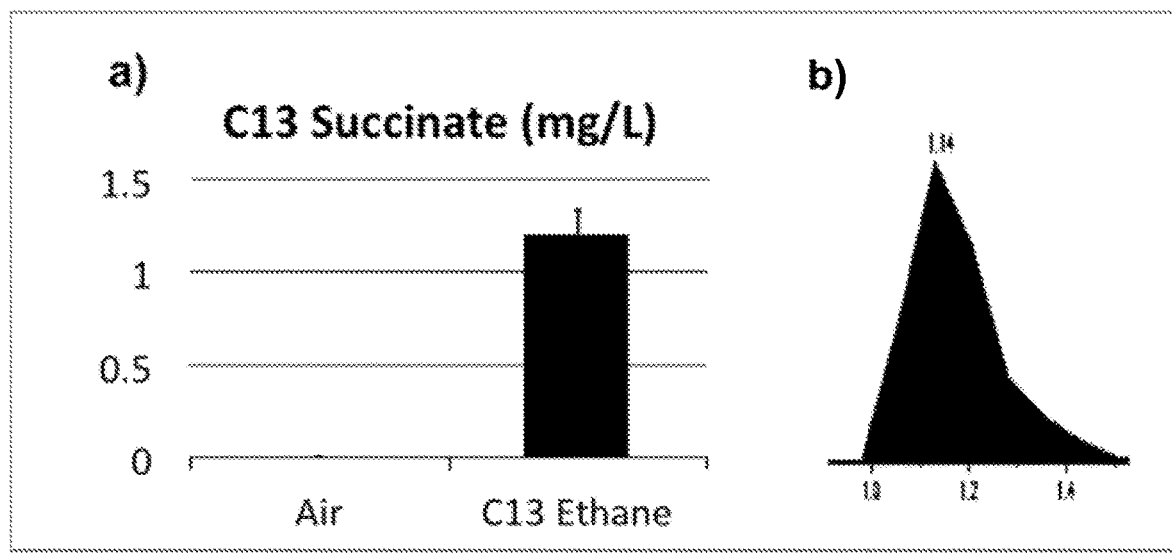
FIG. 8 shows the 13C-labeled succinate produced from a 13C-labeled ethane feedstock. Strain NH606 was sealed into two serum bottles, where one was injected with air and the other with 13C-labeled ethane. The plot in (a) shows the difference in detected 13C-succinate between the two bottles. The peak in (b) is the result of detection of the 13C-succinate peak from the LC/MS/MS method described elsewhere in the specification.
Figure 9:
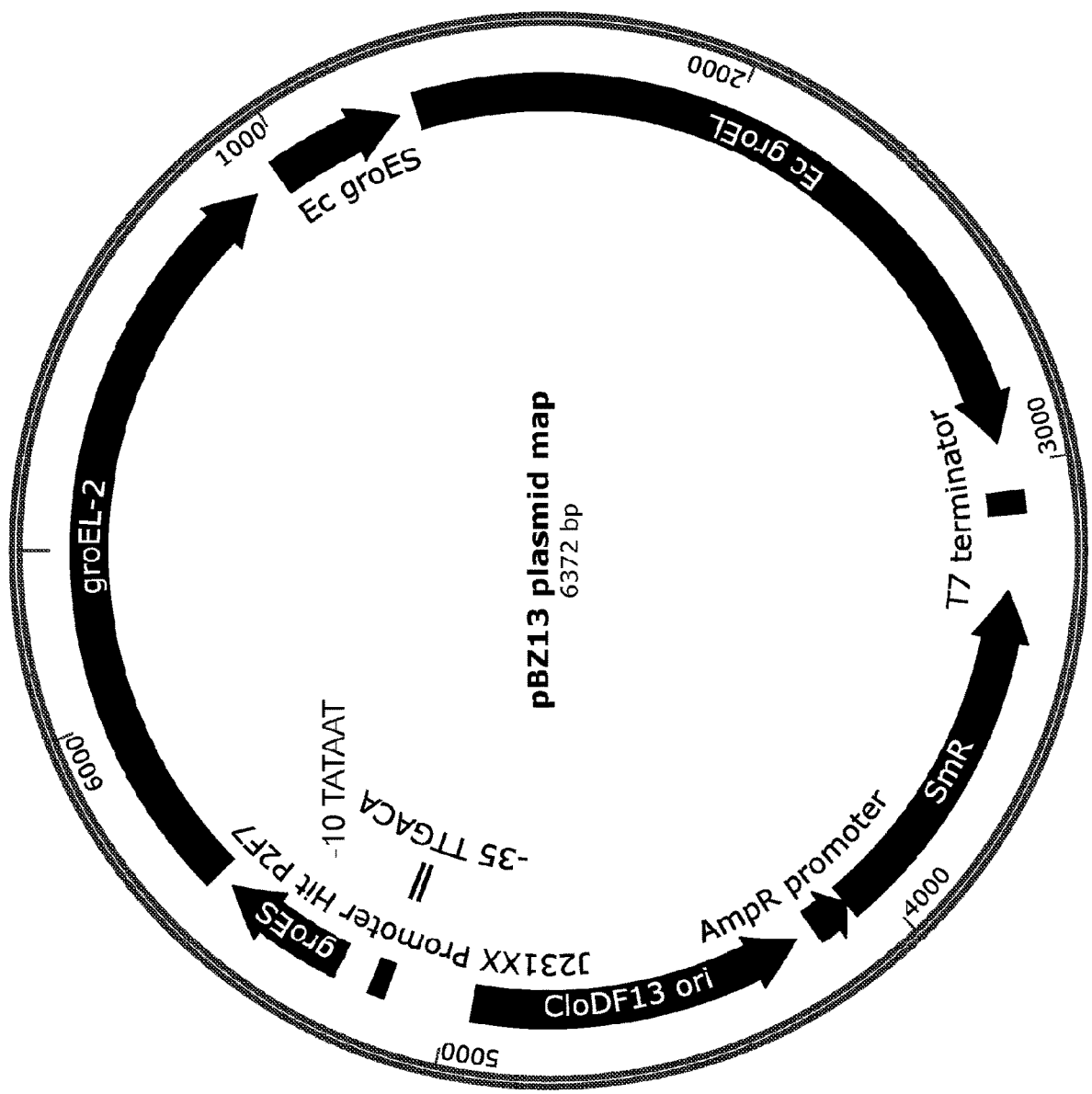
FIG. 9 shows a representative plasmid map illustrating the coding regions for plasmid pBZ13 (SEQ ID NO: 15). This plasmid enables the expression of two sets of chaperone proteins, groES/groEL from *E. coli* and *M. capsulatus* (Bath).

The results of this analysis are shown in FIG. 8. The vial that received an injection of air produced no detectable 13C-succinic acid, while the vial that received an injection of 13C-ethane produced 1.14 mg/L of 13C-succinic acid. This result conclusively shows the functionality of the entire pathway from ethane to succinic acid. This is the first report of a functional soluble diiron monooxygenase in E. coli used in a pathway to generate an industrial product from a hydrocarbon feedstock.

Example 23. Ethane to Succinate in E. coli—Co-Culture

This example describes the conversion of ethane into succinate in a culture containing two engineered microorganisms. One microorganism was a strain of E. coli engineered to convert ethane to ethanol. The other microorganism was a strain of E. coli engineered to convert ethanol into succinate.

Strain Construction of BZ55 and NH585

The strain BZ55 was constructed in the following steps. First, the strain NH283 was constructed as described elsewhere herein. Next the plasmid pBZ13 (SEQ ID NO: 15) was transformed into NH283 by electroporation. The plasmid pBZ23 (SEQ ID NO: 18) contains the sMMO from M. capsulatus (Bath) plus mutations to the following genes: mmoX (K61S, E240N, S421T), mmoY (L67M). The strain NH283 with plasmid pBZ13 was subsequently transformed with this second plasmid, pBZ23, by electroporation, and selected on LB supplemented with kanamycin (50 μg/mL) and spectinomycin (100 μg/mL).

Bioconversion of 13C-Ethane into Succinate

BZ55 was inoculated into 2 mL of LB supplemented with spectinomycin (100 μg/mL) and kanamycin (50 μg/mL) and NH585 was inoculated into 2 mL of LB supplemented with carbenicillin (100 μg/mL). Both cultures were incubated at 37° C., 280 rpm overnight. After 16 hours, 1 mL of BZ55 culture was transferred into 9 mL of LB+spectinomycin+ kanamycin+Fe(III)-citrate (50 μM)+L-cysteine (200 μM)+ L-arabinose (1 mM) and 200 μL of NH585 culture was transferred into 10 mL of LB+IPTG (1 mM). Both 10 mL cultures were incubated at 37° C., 280 rpm for 4 hours. After 4 hours, both cultures were centrifuged for 5 min at 3 krpm. The pellets were resuspended in 30 mL of PBS to wash and centrifuged again. Then the NH585 pellet was resuspended in 5 mL of PBS+glycerol (0.4%)+IPTG+arabinose+Fe(III)- citrate+L-cysteine. This resuspension was used to resuspend the BZ55 pellet, resulting in a 5 mL mixture of the two strains. From this mixture, 1 mL was pipetted into each of two vials and sealed with a rubber stopper. A syringe was used to inject 1.5 mL of air into the headspace above one of the cultures, while another syringe was used to inject 1.5 mL of 13C-labeled ethane (Cambridge Isotope Laboratories) into the headspace above the other. Both vials were incubated at 37° C., 280 rpm. After 48 hours, samples were centrifuged for 3 min at 16.1 krpm and the supernatant was removed and filtered. These filtrates were analyzed by LC/MS/MS, as described in the Example 22 above. The concentrations (in mg/L) of succinate in the air-injected sample and ethane-injected sample are compared in Table 17.

TABLE 17

Comparison of succinate production in co-culture due to 13C-ethane feeding

| Condition | 12C-succinate | 13C-succinate |
|---|---|---|
| Air | 52.1 | 1.05 |
| 13C-Ethane | 56.6 | 1.85 |

The increased amount of 13C-succinate is evidence that the 13C-ethane was converted through the metabolic pathways of the cells into 13C-succinate. It is worth noting that the higher background levels of succinate derive from the glycerol (which is absent in Example 22), and that the significant percentage-wise increase in 13C-succinate in the 13C-ethane-fed condition can be seen relative to the small change in 12C-succinate production. This large percentage increase in 13C-succinate cannot be caused by background fluctuations, but instead must be derived from the 13C-ethane feeding.

Example 24. Ethane to Chemicals in *E. coli*: Ethane to Fatty Acids

This example describes a strain of *E. coli* capable of converting ethane into a chemical product.

The strains of *E. coli* described herein may be combined to generate a single strain of *E. coli* capable of converting ethane into a fatty acid. In principle, a similar strategy may be employed to build strains capable of converting ethane into other chemical products, starting from a strain that is already able to make a chemical product and adding the enzymes responsible for converting ethane to ethanol and, ultimately, into acetyl-CoA.

Methods for combining the two strains are well-known to one skilled in the art. In the simplest case, the genes responsible for key functions, such as ethane assimilation, are localized to a plasmid, which can be transformed into the *E. coli* strain which already comprises a pathway to the fatty acid product. Alternatively, the product pathway genes may be localized to a plasmid which may be transformed into an ethane-consuming strain of *E. coli*.

Another possible embodiment may be comprised of two *E. coli* strains which each have the genetic elements integrated into the chromosome. In this case, the individual genetic elements can be amplified by PCR and transformed into the other strain. Another option is to utilize transduction to move genetic elements between strains. Still another option is to utilize mobilizable genetic elements via conjugation. Still another option is to synthesize part or all of a synthetic chromosome that contains the appropriate genetic elements from both strains and introduce the DNA into a donor strain.

The method for culturing a strain that can consume ethane and produce a fatty acid is straightforward as set forth herein. Briefly, the *E. coli* strain can be grown up in rich media or minimal ethanol media and then transferred to a minimal media without a carbon source. That culture may be transferred to a stoppered bottle and injected with ethane into the headspace. Alternatively, the culture can be grown in a bioreactor with continuous feeding of ethane via sparging. The fatty acids can be harvested by either organic solvent extraction or centrifugation or settling or a combination of these methods.

Example 25. Identifying Genetic Elements that Improve Monooxygenase Function

This example describes the construction of a genetically engineered host cell wherein the expression of exogenous genes coding for proteins or RNAs of unknown function in the engineered host cell results in an engineered cell improved for growth on ethane. This example further describes a natural hydrocarbon-consuming organism that has been modified to consume ethane at a different rate, in order to identify genes or enzymes necessary for ethane consumption.

Complementation libraries may be searched for protein partners or chaperones that are missing from the host strain, and whose expression increases the growth rate on ethane. Here, libraries will be constructed by cloning plasmids containing random genomic DNA fragments from natural microorganisms with monooxygenase or hydrocarbon-oxidation activity. DNA will be isolated from one or more of such strains, digested or sheared into fragments, and cloned into a plasmid suitable to the host strain. In some cases, for expression in a yeast host strain, a yeast artificial chromosome may be appropriate. In some cases, for expression in a bacterial host strain, a cosmid, or a bacterial artificial chromosome may be appropriate. In some cases, the digested genomic DNA is linked to a selective marker, and integrated directly into a host cell chromosome. Improvements in growth rate or product formation may be measured, as described herein. Genome-scale analysis may reduce the size of such libraries, and genomic intersection techniques may identify genes common to monooxygenase-expressing organisms and absent in the engineered host (M G Kalyuzhnaya et al., *Functional metagenomics of methylotrophs*, 495 Methods in Enzymology 81-98, 2011).

Loss-of-function strain libraries may be used to identify genes essential for oxidation of ethane to ethanol. Here, a strain collection with random genetic changes ("a library") may be generated in a natural microorganism that can consume hydrocarbons, and the reduction (or loss) of its ability to grow on ethane is used to identify key genes. These genes may then be expressed in the engineered host cell and tested for improvements in host cell growth using ethane as the carbon source.

One example of this type of library is a transposon library. A large library may be generated in a natural hydrocarbon-consuming organism. This library would be plated onto ethanol-containing agar plates and then replica-plated onto agar plates without ethanol, but grown in the presence of gaseous ethane. Mutants with diminished ethane-oxidation activity will be able to grow on ethanol, but will have decreased growth rate on ethane. Mutations can be identified using arbitrarily primed PCR methods or by DNA sequencing using primers common to the transposon DNA. This method identifies genetic elements that are tested in our synthetic ethanotrophs for growth improvement in an ethane-fed fermentation. This example of transposon mutagenesis is exemplary and not meant to be limiting. The method of screening a mutated hydrocarbon-consuming organism applies equally well to other methods of mutagenesis, such as, but not limited to, chemical mutagenesis, ultraviolet-light-induced mutagenesis, targeted mutagenesis, and others. In these cases, it may be most helpful to identify relevant mutations by whole genome sequencing.

Another method for improving monooxygenase function is protein engineering. There are many techniques for performing protein engineering. In one method, mutations are discovered by error-prone PCR and screened for improved function. These mutations are identified by DNA sequencing and a recombination library may be built in which mutations (either beneficial or neutral) may be combined randomly. The method of building the recombination library may be chosen from a range of previously described methods, such as tPCR (A Erijman et al., *Transfer-PCR (TPCR): A highway for DNA cloning and protein engineering*, 175 Journal of Structural Biology 171-177, 2011). The recombination library may be screened for improved function. The most improved enzymes can be sequenced, and can also be used as templates for further engineering.

All of the above methods can be equally well applied to methanotrophs. Complementation and overexpression libraries can be constructed from the genomic DNA of natural methanotrophs for expression in heterologous hosts. Loss-of-function mutagenic libraries and transposon libraries can be built in methanotrophic bacteria to search for critical genetic elements. Protein engineering monooxygenases for improved activity against a range of substrates (e.g. methane, ethane, propane, butane, naphthalene, etc.) can be carried out as described above, provided that a suitable measurement technique (such as a colorimetric assay or the alcohol assay described elsewhere herein) can be employed in moderate throughput.

Example 26. Screening eDNA Libraries for Ethane Monooxygenase Function or Improved Monooxygenase Function This example describes the construction and screening of libraries of environmental DNA samples in order to find functional ethane monooxygenase enzymes or to find components that improve the function of a monooxygenase.

As described in the example above, one may construct a library of genomic DNA and screen that library for desirable functions. In a similar manner, one may construct and screen libraries of environmental DNA. Methods for the construction of such libraries are described in the academic literature and elsewhere (A Henne et al., *Construction of environmental DNA libraries in Escherichia coli and screening for the presence of genes conferring utilization of 4-hydroxybutyrate*, 65 Applied and Environmental Microbiology 3901-3907, 1999); (S F Brady, *Construction of soil environmental DNA cosmid libraries and screening for clones that produce biologically active small molecules*, 2 Nature protocols 1297-1305, 2007). Briefly, an environmental sample is taken from a location of interest. In one relevant case, that location may be an area where it is known that microbes capable of oxidizing hydrocarbons grow. Then the DNA of the entire sample is separated from everything else and purified. This DNA contains a mixture of the DNA from many different organisms. This extracted environmental DNA can be cloned into a plasmid (sometimes known as a cosmid or fosmid) in such a way as to be amenable to insertion into a transformable microorganism, such as *E. coli*. Recent advances in the library construction protocol have enabled extremely large and diverse libraries to be constructed. These libraries can be screened under myriad conditions to identify interesting features, after which the genes responsible can be extracted and further studied. In this particular case, these libraries can be tested for ethane monooxygenase activity using the selection methods described above. Additionally, one may add to the screening strain a plasmid or chromosomal genetic element or series of genetic elements that express a known ethane oxidizing enzyme complex. Then, the environmental DNA library can be screened in this strain in order to identify genetic elements that may enable or improve the desired activity, in this case, that of an ethane monooxygenase. An example of a genetically encoded element that could improve function may be a protein-folding chaperone (T Furuya et al., *The mycobacterial binuclear iron monooxygenases require a specific chaperonin-like protein for functional expression in a heterologous host*, 280 FEBS Journal 817-826, 2013) or a protein that assists in properly assembling the metal centers in a metalloenzyme.

Example 27. Functional Expression of Methane Monooxygenase in *C. glutamicum*

This example describes the expression of a functional monooxygenase in *Corynebacterium glutamicum*.

Construction of Plasmid pNH238

Plasmid pBZ21 (SEQ ID NO: 17) was constructed in the following manner Two fragments were generated using PCR to amplify a 6.4 kb fragment from pBZ13 (SEQ ID NO: 15) with primers oBZ095 (SEQ ID NO: 74) and oBZ096 (SEQ ID NO: 75) and a second fragment (6.8 kb) from pDG6 (SEQ ID NO: 22) with primers oBZ090 (SEQ ID NO: 76) and oBZ094 (SEQ ID NO:77). These fragments were isolated and combined using Gibson assembly. The resulting DNA was transformed into electrocompetent *E. coli* and transformants were selected on LB agar supplemented with spectinomycin (100 µg/mL). Correct colonies were identified by colony PCR and tested to confirm monooxygenase activity. This plasmid was isolated and used as a template for PCR amplification with primers oNH600b (SEQ ID NO: 78) and oNH601s (SEQ ID NO: 79). The resulting reaction was treated with DpnI restriction enzyme to remove the plasmid template. PCR amplification was used to generate a second DNA fragment, with pDG6 (SEQ ID NO: 22) as the template, and using primers oNH602b (SEQ ID NO: 80) and oNH603 (SEQ ID NO: 81). Both fragments were isolated, assembled with Gibson assembly, and transformed into electrocompetent *E. coli*. Transformants were selected on LB agar plates supplemented with spectinomycin (100 µg/mL) and kanamycin (50 µg/mL). Correct colonies were identified by colony PCR. The plasmids were isolated and transformed into *E. coli* strain ER2925, a dam- dcm-strain. These colonies were used to isolate pNH238 DNA (SEQ ID NO: 46) without dam or dcm methylation for efficient transformation into *C. glutamicum*. The *C. glutamicum* strain NRRL B-3330 was made electrocompetent according to the method of van der Rest (van der Rest et al., *A heat shock following electroporation induces highly efficient transformation of Corynebacterium glutamicum with xenogeneic plasmid DNA*, Appl. Microbiol. Biotechnol., Vol 52(4), 1999). Transformants were selected on LBHIS agar plates supplemented with kanamycin (20 µg/mL).

A single colony (named NH686) was inoculated into LB supplemented with sorbitol (20 mM) and kanamycin (20 µg/mL). The control strain, *C. glutamicum* NRRL B-3330, was inoculated into LB supplemented with sorbitol (20 mM). Both strains were placed at 30° C., shaking at 220 rpm. After 16 hours, 1 mL of the culture was added to 9 mL of LB supplemented with sorbitol (20 mM), L-arabinose (1 M), and $FeSO_4$ (80 µM). Strain NH687 containing the pNH238 plasmid was also supplemented with kanamycin. These strains were placed at 30° C., 220 rpm, for 6 hours. The cultures were then centrifuged at 4 krpm for 5 min. The cultures were washed once in 10 mL PBS and 800 µL was pipetted into a microcentrifuge tube and pelleted. These pellets were resuspended in 250 µL of PBS supplemented with coumarin (11 mM), sorbitol (0.1 M), L-arabinose (1 M), and $FeSO_4$ (80 µM). All tubes were incubated at 30° C., shaking at 220 rpm. A functional monooxygenase will hydroxylate coumarin to umbelliferone, which can be measured by fluorescence. After 42 hours, the tubes were removed and centrifuged. 150 µL of the supernatant was pipetted into a clear-bottom plate and the fluorescence was read on a plate reader. The excitation wavelength was 360 nm and the emission wavelength was 460 nm. The background fluorescence of the media (lacking any cells) was subtracted from both the control strain and NH687. The fluorescence of NRRL B-3330 was found to be 151, while the fluorescence of the monooxygenase-expressing strain NH687 was 664. This significant increase in fluorescence demonstrates the hydroxylation of the substrate by an active monooxygenase in NH687.

Example 28. Bioconversion of Ethanol to Amino Acids in *C. glutamicum*

Strains of *Corynebacterium glutamicum* have been shown to overproduce glutamate (NRRL B-2784) or lysine (NRRL B-3330). These strains have been tested in our lab and shown to consume ethanol as a sole carbon and energy source. Growth on a modified minimal media with ethanol as the only carbon source may result in the accumulation of glutamate and/or lysine from these strains. Cells can be cultured in a standard rich media, such as BHIS (A Vertes et al., *MINIREVIEW Manipulating Corynebacteria, from Individual Genes to Chromosomes*, 71 7633-7642, 2005), and then transferred into a minimal media formulation, such as CGXII but with ethanol substituted for glucose as the carbon source (A Vertes et al., *MINIREVIEW Manipulating Corynebacteria, from Individual Genes to Chromosomes*, 71 7633-7642, 2005). In another media formulation, *C. glutamicum* strains were grown in a modified M9 medium containing M9 salts, 2 mM $MgSO_4$, 0.2 mM $CaCl_2$, 10 µM $FeSO_4$, R5 trace elements, 4 mg/L biotin, and 1% (v/v) ethanol. The strains were inoculated into this media at incubated at 30° C., shaking at 200 rpm. After 24 hours, the strains grew to an OD600 of 1.5. The cells can be separated from the broth by centrifugation and the amount of glutamate or lysine produced in the broth can be analyzed using standard methods known to one skilled in the art.

Example 29. Bioconversion of Ethane to Amino Acids in *C. glutamicum*

This example describes a strain and method for culturing a strain to produce amino acids from an ethane feedstock in *Corynebacterium glutamicum*.

The strain from above is capable of growth on ethanol as a major or sole carbon source. By expressing an ethane-oxidizing enzyme in this strain, one may construct a strain capable of converting ethane into amino acids, such as glutamate or lysine. Enzymes that may oxidize ethane in *Corynebacterium glutamicum* can be selected from Table 1 and expressed from plasmid(s) or from a chromosomal locus.

This strain may be cultured in a rich media, such as BHIS, and then transferred into sealed serum bottle containing a minimal media with no carbon source, such as CGXII lacking glucose. The sealed bottle can be injected with ethane into the headspace above the media in order to provide a carbon source. Alternatively, a limiting amount of ethanol can be included in the minimal media to condition the cells for growth via the ethanol-assimilation pathway or to provide some carbon for the case in which the ethane-oxidation is functional but not sufficient to support growth. Additionally, the strain may be continuously cultured in a bioreactor, chemostat, or turbidostat to maintain constant growth conditions.

The strains NH686 and NH687 can be tested as above with ethane as the feedstock, injected into the headspace above the culture in a sealed serum bottle, as described elsewhere herein.

Example 30. Functional Expression of Toluene-4-Monooxygenase in *Pichia pastoris*

The monooxygenases described above can be expressed in yeast from plasmids or via chromosomal integrations. The genetic constructs may be assembled using standard promoters and terminators to drive the transcription and translation of the desired polypeptides. Some exemplary promoters that are commonly used include the promoters PADH1, PTEF1, PTEF2, PGAP. Some exemplary terminators include TCYC1, TTEF1, TILV5, TGAP, TAOX1. These genetic constructs can be transformed into the yeast cells using standard methods such as electroporation and chemical transformation, described elsewhere (J M Cregg et al., Recombinant protein expression in *Pichia pastoris.*, 16 MOLECULAR BIOTECHNOLOGY 23-52, 2000). Colonies can be checked for correct genetic signatures using colony PCR methods.

A method for testing a yeast strain for functional monooxygenase enzymes is similar to the method for *E. coli* described above. Briefly, the yeast cells are cultured in a rich media, such as YPD, until the culture reaches an OD600 equal to about 1.5 and then it is washed in minimal media or PBS. To test the strain for activity with naphthalene as a substrate, as an example, the yeast cells are resuspended in 1 mL of PBS with naphthalene added. The culture is then incubated at 30° C., shaking at 220 rpm, for 16 hrs. Then, the culture is centrifuged to separate the cells and the supernatant and cell pellet are assayed with Fast Blue B salt dissolved in water. If the culture changes color, then 1-naphthol has been produced. The color change can be read using a spectrophotometer at 540 nm, and compared to a control strain which does not oxidize naphthalene. The method for testing for methane or ethane oxidation is similar except the naphthalene is omitted, the culture is inoculated into a sterile, sealed serum bottle and the methane or ethane gas is injected into the headspace above the culture. The assay for methanol or ethanol is similar to that described herein.

In one specific example, *Pichia pastoris* strain NH393 was constructed in the following manner and observed to oxidize naphthalene to 1-naphthol when assayed as above. Two plasmids were designed to contain the six genes of the toluene-4-monooxygenase from *Pseudomonas mendocina* KR1, each expressed from its own promoter and terminator pair. These two plasmids (pNH104 expressing tmoA, tmoB, tmoC is SEQ ID NO: 29 and pNH132 expressing tmoD, tmoE, tmoF is SEQ ID NO: 30) were constructed by cloning a standard vector and a fragment that was synthesized by standard DNA synthesis techniques by an outside vendor. These plasmids were digested with restriction enzyme BsaI and transformed into *P. pastoris* (NRRL Y-11430) using standard electroporation techniques (J. Lin-Cereghino et al., Condensed protocol for competent cell preparation and transformation of the methylotrophic yeast *Pichia pastoris*, Biotechniques, vol. 38.1, p. 44-48, 2005). The transformants were selected on YPD supplemented with antibiotics (G418 (Geneticin) at 250 μg/mL, nourseothricin at 25 μg/mL). These were streaked for single colonies on the same YPD+antibiotics media and checked by colony PCR for proper integration of the desired DNA at the appropriate locus. Strain NH393 was isolated in this way with confirmed integrations of the DNA that expresses the toluene-4-monooxygenase. This strain was tested for naphthalene oxidation, as described above. When the Fast Blue B reagent was mixed with the cell pellet and mixed, a color change to purple accompanied only the strain expressing the monooxygenase (NH393), but not in the control strain (Y-11430). This indicates the functional expression of this soluble diiron monooxygenase in P. pastoris. To our knowledge, this is the first instance of a heterologous soluble diiron monooxygenase enzyme being functionally expressed in a yeast cell.

Example 31. Functional Expression of Methane Monooxygenase in Pichia pastoris

This example describes the functional expression of two monooxygenases in the methylotrophic yeast Pichia pastoris (also known as Komagataella phaffii).

Plasmid Construction

The plasmids pNH166 (SEQ ID NO: 34), pNH167 (SEQ ID NO: 35), pNH172 (SEQ ID NO: 36), pNH173 (SEQ ID NO: 37) were constructed in the following manner. Synthetic DNA was designed to express the six subunits of the monooxygenase and the groES and groEL chaperonin subunits. Plasmids pNH166 and pNH172 encode the monooxygenase from the bacterial strain Methylocystis sp LW5 and plasmids pNH167 and pNH173 encode the monooxygenase from the bacterial strain Solimonas aquatica (DSM 25927). The DNA was synthesized from a commercial vendor (Gen9). These sequences were digested with restriction enzyme XhoI. Cloning vectors were amplified by PCR to provide sequences at the ends of the linear amplicon corresponding to a homologous sequence at the end of the desired DNA to be inserted. The resulting reaction mix was treated with restriction enzyme DpnI to remove the background plasmid, leaving only the amplified DNA. Both the cloning vectors and the XhoI-digested DNA for insertion were purified using DNA columns (Zymo Research). The inserts were ligated to the cloning vectors using Gibson Assembly (New England Biolabs). The Gibson reaction was purified with a DNA column and transformed into electrocompetent E. coli cells. Single colonies of the transformation were isolated and confirmed correct by colony PCR. The resulting plasmids contained the desired insert flanked by sequences that are homologous to a chromosomal region in the host (for integration by homologous recombination). Additionally, the plasmids contain an antibiotic selection marker that can be used to isolate clones of the host strain that have successfully integrated the desired DNA fragment at the intended location.

Strain Construction

The strain MC100-3 (in which both alcohol oxidase genes were deleted, preventing the degradation of methanol) was grown in 5 mL of YPD media, shaking at 220 rpm and 30° C., to an OD of approximately 1.5. The plasmids were digested with the restriction enzyme BsaI to generate a linear fragment for integration. The resulting reaction was purified by DNA column, as above, and eluted in 10 μL. The strain was transformed using standard techniques (J. Lin-Cereghino et al., Condensed protocol for competent cell preparation and transformation of the methylotrophic yeast Pichia pastoris, Biotechniques, vol. 38.1, p. 44-48, 2005) Briefly, the culture was centrifuged and washed in sorbitol (1 M) twice and concentrated into 100 μL. From the purified DNA elution, 3 μL was used in an electroporation cuvette, along with the washed cells. Cultures were recovered at 30° C. and 220 rpm for 2 hours before plating on YPD+antibiotic agar plates. For integration cassettes containing a resistance gene for nourseothricin, the YPD plates contained nourseothricin at a concentration of 25 μg/mL. For cassettes containing a gene providing resistance to geneticin (G418), the concentration of G418 in the YPD plates was 500 μg/mL.

Specifically, strain NH461 is MC100-3, which is Komagataella phaffii with mutations inactivating both alcohol oxidase enzymes Aox1p and Aox2p, rendering this strain incapable of degrading or consuming methanol. Strain NH509 was constructed by sequentially integrating the DNA cassettes from pNH172 and pNH166. This strain was isolated as a single colony and confirmed by colony PCR to have integrated the desired DNA cassettes into the intended chromosomal locations. A similar procedure was used to generate strain NH510 from pNH173 and pNH167.

Methane Oxidation Assay

Strains NH461, NH509, and NH510 were assayed for methane oxidation, as described herein. Briefly, the strains were separately inoculated into 1 mL of YPD and placed at 30° C. and 220 rpm overnight. The following day, each strain was subcultured using 500 μL of culture into 25 mL of YPD+FeSO$_4$ (80 μM) at 30° C. and 220 rpm for 6 hours. The cultures were centrifuged at 4 krpm for 5 min and resuspended in 10 mL of phosphate buffered saline plus 0.8% glycerol and FeSO$_4$ (80 μM). These cells were pipetted into serum bottles, 5 mL into each bottle, and stoppered and sealed with butyl rubber stoppers. One bottle was injected with 60 mL air into the headspace using a syringe while the other bottle was injected with 60 mL of methane gas. These sealed bottles were incubated upright at 30° C., 220 rpm. After 72 hours of incubation, the bottles were removed from the incubator and sampled for methanol. The method of detection for methanol was described elsewhere herein. A commercially-available kit using an enzymatic assay generates a colorimetric readout that can be calibrated using a standard curve of known methanol concentrations. This assay was performed according to the manufacturer's instructions. The concentration of methanol in the samples was calculated as described above, using the air-injected samples as controls. Using this method, the strains were observed to make the following concentrations of methanol. The strain NH509 produced 20 μM of methanol and NH510 produced 55 μM of methanol, while the control strain NH461 produced almost no methanol (less than 3 μM, within the noise of the assay).

TABLE 18

Bioconversion of methane to methanol in Pichia pastoris

| Strain | mmoXYZC | mmoBD-groES/EL | Methanol (uM) |
|---|---|---|---|
| NH461 (MC100-3) | None | None | <3 |
| NH509 | Methylocystis | Methylocystis | 20 |
| NH510 | S. aquatica | S. aquatica | 55 |

The functional expression of the monooxygenase is evidenced by the conversion of methane into methanol in these strains.

Example 32. Protein Folding Chaperones Improve Function of sMMO in P. pastoris

This example describes the improvement in monooxygenase activity in P. pastoris due to the co-expression of a protein-folding chaperone.

The expression of a monooxygenase enzyme complex has been described herein. Briefly, the different enzyme subunits are expressed individually from promoters and followed by terminators. Additionally, one can express other open reading frames from promoters and terminators in the same way. One such additional protein complex is the bacterial groES/groEL protein-folding chaperonin. In the same manner that this chaperonin aids in the activity of the monooxygenase complex in bacteria, adding the groES/groEL open reading frames to a yeast strain will also improve the functionality of the monooxygenase in a yeast cell.

Example 33. Ethanol to Malate in *P. pastoris*

This example describes the conversion of ethanol into malate in an engineered strain of *Pichia pastoris*.

The strain NH038 was constructed to constitutively express a pathway from pyruvate to malate along with a malate transporter to export malate from the cell. The plasmid pNH001 (SEQ ID NO: 82) was constructed with 750 bp homology to the HSP82 locus flanking either side of a KanMX gene cassette providing resistance to G418/Geneticin antibiotic. DNA fragments containing the sequences encoding the promoter PTEF2 from *Pichia pastoris*, the coding sequence from the malate transporter from *Schizosaccharyomyces pombe*, and the terminator TCYC1 from *Saccharoymyces cerevisiae* were amplified from genomic DNA prepared from their respective strains. These three fragments were added to the pNH001 backbone using Gibson cloning to generate pNH010 (SEQ ID NO: 85). Separately, three DNA fragments were amplified by PCR to construct a cassette containing the promoter PGAP from *Pichia pastoris*, the malate dehydrogenase (lacking the last three amino acids which serve as a peroxisomal targeting sequence) from *Saccharomyces cerevisiae*, and the terminator TGCW14 from *Pichia pastoris*. These three fragments were added to the pNH001 backbone using Gibson cloning to generate pNH009 (SEQ ID NO: 84). Similarly, three DNA fragments were amplified by PCR to construct a cassette containing the promoter PGCW14 from *Pichia pastoris*, the coding sequence of PYC2 from *Saccharomyces cerevisiae*, and the terminator TAOX1 from *Pichia pastoris*. These three fragments were combined into the backbone from pNH001 using Gibson cloning and named pNH003 (SEQ ID NO: 83). Combining these cassettes was also performed using Gibson cloning. The plasmid backbone from pNH010 (SEQ ID NO: 85) was amplified and an insert made by amplifying pNH009 (containing the desired PGAP-MDH3(☐SKL)-TGCW14 fragment). The subsequent plasmid, pNH011 (SEQ ID NO: 86), was then digested with NotI restriction enzyme. The DNA fragment encoding PGCW14-PYC2-TAOX1 was amplified from pNH003 and Gibson cloned into the pNH011 NotI-digested backbone. The resulting plasmid, pNH014 (SEQ ID NO: 57), contained all three cassettes to express the three genes in *Pichia pastoris*: PYC2, MDH3(ΔSKL), and MAE1. These three genes convert pyruvate into oxaloacetate and then into malate before exporting it from the cell. This plasmid was digested with BsaI in order to linearize the fragment containing the 750 bp homology to the HSP82 locus surrounding the three gene expression cassettes and a KanMX marker. The strain Y-11430 (*Pichia pastoris*) was transformed using standard methods and the recovered cells were plated on YPD+Geneticin (250 μg/mL) for 2 days. Colonies were verified by PCR to contain the desired DNA at the intended locus. A single colony from the transformants was selected for fermentation and named NH038.

Strain NH038 was fermented using a minimal media containing ethanol as the sole carbon source. First the strain was grown to stationary phase overnight in 1 mL of YPD media shaking at 200 rpm at 30° C. From this overnight culture, 20 μL was subcultured into 1 mL of buffered minimal media containing ethanol (13.4 g/L YNB+metals (Biobasic), 100 mM $KH_2PO_4$ pH 6.0, 0.00004% biotin, 2% ethanol). The culture was placed at 30° C., 200 rpm shaking. After 44 hours, the culture was centrifuged at 16.1 krpm for 2 min and the supernatant was sampled for HPLC analysis. The HPLC analysis was performed as described above (Example 21), except a standard curve of malate (rather than succinate) samples was generated from commercially available purified malic acid (Sigma Aldrich). HPLC analysis detected 90 mg/L of malic acid in the sample. The same strain was cultured in buffered minimal media containing glucose and HPLC analysis detected 440 mg/L, while in media containing no added carbon source, the culture failed to grow.

Example 34. Ethanol to Secreted Protein in *P. pastoris*

*Pichia pastoris* has long been a model organism for the production of secreted proteins for a range of applications, including therapeutics. *P. pastoris* has the ability to grow on ethanol, as demonstrated in our lab. *P. pastoris* strains capable of protein production can be grown on ethanol as a sole carbon source and the proteins can be separated from the cells and media for relevant applications. Genetic constructs for secreted proteins are well understood, where the DNA sequence encoding the protein of interest is appended to a secretion signal. One common secretion signal is that of the alpha-factor peptide. A strain of *P. pastoris* may be constructed by first cloning the alpha-factor gene fused to another gene of interest (the protein to be secreted). This construct can be used to modify the genome of *P. pastoris* by electrocompetent transformation techniques described elsewhere (J L Cereghino & J M Cregg, *Heterologous protein expression in the methylotrophic yeast Pichia pastoris*, 24 FEMS microbiology reviews 45-66, 2000). Transformants are selected using antibiotic selections, such as zeocin, nourseothricin, or G418. Colonies are purified by streaking on rich media agar plates containing the antibiotic, and the correct genetic construct is confirmed by colony PCR amplification and sequencing. These strains may be cultured in minimal media containing ethanol as the major or sole carbon and energy source. One such media formulation contains yeast nitrogen base (available commercially from many sources, such as Difco or Sigma Aldrich), biotin (final concentration 0.4 mg/L), and ethanol (final concentration 1% v/v). In an alternative formulation, a buffer can be added to stabilize the pH, such as $KH_2PO_4$ (pH 6.0) at 100 mM final concentration. Strain Y-11430 was inoculated into YPD media and incubated at 30° C., shaking at 200 rpm. After 16 hours, 10 μL of this culture was transferred into 2 mL of the buffered minimal media with 1% ethanol, described above. After 24 hours, this culture had grown to an OD600 of 2.0.

Example 35. Improved Aerobic Growth on Ethanol as a Major or Sole Carbon Source in *S. cerevisiae*

The growth of *S. cerevisiae* on ethanol as a sole carbon source is also possible using an enzyme pathway that converts ethanol into acetyl-CoA, via acetaldehyde. In an analogous manner to the methods described above for *E. coli*, the expression and regulation of the enzymes in this pathway can be synthetically altered using targeted or random strategies. Libraries of genetic variants can be assayed in a growth competition in the same way, using appropriate media and growth conditions for the yeast *S. cerevisiae*. For example, the expression and regulation of the yeast gene ADH2 may be altered to increase the growth rate on ethanol as a major or sole carbon source. ADH2 is the gene that encodes the alcohol dehydrogenase that is responsible for conversion of ethanol into acetaldehyde. Likewise, the genes ALD4 and ALD6 are required for conversion of acetaldehyde to acetate and are activated during growth on ethanol. Altering the expression of any or all of these may improve growth on minimal ethanol media. Furthermore, as described above, random strategies, such as chemical mutagenesis, may also improve growth on ethanol media and may be utilized to identify genes for further improvements.

Example 36. Synthetic Ethanotroph in Yeast

Several yeast strains, including the most commonly used *Saccharomyces cerevisiae* and *Pichia pastoris*, are capable of growth on ethanol under aerobic conditions.

The procedure to convert these strains into synthetic ethanotrophs is conceptually similar to the method for converting a bacterial strain, though it differs in some details, as described below. The monooxygenases shown above in Table 1 can be expressed in yeast from plasmids or via chromosomal integrations. The genetic constructs may be assembled using standard promoters and terminators to drive the transcription and translation of the desired polypeptides. Some exemplary promoters that are commonly used include the promoters PADH1, PTEF1, PTEF2, PGAP. Some exemplary terminators include TCYC1, TTEF1, TILV5, TGAP, TAOX1. These genetic constructs can be transformed into the yeast cells using standard methods such as electroporation and chemical transformation, described elsewhere (J M Cregg et al., *Recombinant protein expression in Pichia pastoris.,* 16 Molecular biotechnology 23-52, 2000). Colonies can be checked for correct genetic signatures using colony PCR methods.

A method for testing a yeast strain for successful, functional ethane-oxidizing enzymes is similar to the method for *E. coli* described above. Briefly, the yeast cells are cultured in a rich media, such as YPD, and then washed in minimal media with ethanol as the major or sole carbon source. The cells may be grown or passaged in minimal ethanol media to adapt them to this mode of growth. The minimal ethanol media contains everything needed for the yeast cells to grow, with ethanol as the only source of carbon. The next step is to wash the cells with minimal media lacking any carbon source at least once, and then to resuspend the cells in this minimal, no-carbon media in a serum bottle, plug the top with a stopper and inject ethane into the headspace above the liquid. This ethane provides the major or sole carbon source for the cells, if they are capable of converting it to ethanol, via the monooxygenase enzyme complex being expressed. This sealed bottle can be incubated for a prolonged time period to allow the ethane to dissolve into the media and for the cells to consume the ethane and grow. Growth can be measured either by an increase in optical density of the culture, relative to a control into which no ethane has been injected, or by counting the colony forming units for both the experiment and control.

Related experiments involve the targeting of the monooxygenase subunits to various subcompartments of the yeast cell, such as the peroxisome, the endoplasmic reticulum, and the mitochondria. Targeting tags for each have been studied and published in the literature. For targeting to the peroxisome, a serine-lysine-leucine tripeptide (SKL) is genetically encoded at the C-terminus of each polypeptide subunit. For targeting to the endoplasmic reticulum, a lysine-aspartate-glutamate-leucine tetrapeptide (KDEL) is genetically encoded at the C-terminus of each polypeptide subunit. For targeting to the mitochondrial matrix, there are many published tags (F Hartl et al., *Mitochondrial protein inport,* 988 Biochimica et biophysica acta 1-45, 1989), but the most common is the tag from the Su9 F0 ATPase subunit.

As described in herein, it may be preferable to grow the strains in a competition with ethane as the major or sole carbon source, or it may yield more reliable results to feed a limiting amount of ethanol plus an excess of ethane. A growth advantage is realized by a cell with a functional monooxygenase in either case, a situation which will ultimately result in those cells coming to occupy the largest fraction of the culture's population.

Example 37. Ethane to Protein in Yeast this Example Describes a Strain of Yeast Capable of Converting Ethane into a Commercial Product The strains of *P. pastoris* described above may be combined to generate a single strain of *P. pastoris* capable of converting ethane into a secreted protein.

The methods to combine these two genetic elements into a single strain are well known to anyone skilled in the art. The DNA can be designed and assembled using standard techniques and integrated into the host genome by transformation and antibiotic selection, as described above. Similar methods can be used for *S. cerevisiae* or other well-studied yeast, as well.

Any yeast strain that is capable of growing on ethane is itself a source of single cell protein, and can be sold as such. Single cell protein is used as a nutrient source for fishmeal and even as a source of protein in food for people.

All references cited herein are incorporated by reference as if each had been individually incorporated by reference in its entirety. In describing embodiments of the present application, specific terminology is employed for the sake of clarity. However, the invention is not intended to be limited to the specific terminology so selected. Nothing in this specification should be considered as limiting the scope of the present invention. All examples presented are representative and non-limiting. The above-described embodiments may be modified or varied, without departing from the invention, as appreciated by those skilled in the art in light of the above teachings. It is therefore to be understood that, within the scope of the claims and their equivalents, the invention may be practiced otherwise than as specifically described.

SEQUENCE LISTING (154 sequences)

SEQ ID NO: 1 - DNA, 54 bp, Artificial Sequence
  Synthetic primer
gtttgattggctgtggttttatacagtcatacctgtgacggaagatcacttcgc

SEQ ID NO: 2 - DNA, 46 bp, Artificial Sequence
  Synthetic primer
gctttttatcgcaactctctactgtttctcttacgccccgccctgc

SEQ ID NO: 3 - DNA, 29 bp, Artificial Sequence
  Synthetic primer.
tgactgtataaaaccacagccaatcaaac

SEQ ID NO: 4 - DNA, 24 bp, Artificial Sequence
  Synthetic primer.
atgcggtttcagacgggcattaac

SEQ ID NO: 5 - DNA, 30 bp, Artificial Sequence
  Synthetic primer.
gagaaacagtagagagttgcgataaaaagc

SEQ ID NO: 6 - DNA, 24 bp, Artificial Sequence
  Synthetic primer.
tggcgggaacagcaaaatatcacc

SEQ ID NO: 7 - DNA, 426 bp, Methylococcus capsulatus (Bath)
atgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaa

SEQ ID NO: 8 - protein, 141 aa, Methylococcus capsulatus (Bath)
MSVNSNAYDAGIMGLKGKDFADQFFADENQVVHESDTVVLVLKKSDEINTFIEEILLTDYKKNVNPTVNVEDRAGYWWIKANGKIEVDCDEISELLGRQFNVYDFLVDVSSTIGRAYTLGNKFTITSELMGLDRKLEDYHA

SEQ ID NO: 9 - DNA, 1584 bp, Methylococcus capsulatus (Bath)
atggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattga

SEQ ID NO: 10 - protein, 527 aa, Methylococcus capsulatus (Bath)
MALSTATKAATDALAANRAPTSVNAQEVHRWLQSFNWDFKNNRTKYATKYKMANETKEQFKLIAKEYARMEAVKDERQFGSLQDALTRLNAGVRVHPKWNETMKVVSNFLEVGEYNAIAATGMLWDSAQAAEQKNGYLAQVLDEIRHTHQCAYVNYYFAKNGQDPAGHNDARRTRTIGPLWKGMKRVFSDGFISGDAVECSLNLQLVGEACFTNPLIVAVTEWAAANGDEITPTVFLSIETDELRHMANGYQTVVSIANDPASAKYLNTDLNNAFWTQQKYFTPVLGMLFEYGSKFKVEPWVKTWNRWVYEDWGGIWIGRLGKYGVESPRSLKDAKQDAYWAHHDLYLLAYALWPTGFFRLALPDQEEMEWFEANYPGWYDHYGKIYEEWRARGCEDPSSGFIPLMWFIENNHPIYIDRVSQVPFCPSLAKGASTLRVHEYNGQMHTFSDQWGERMWLAEPERYECQNIFEQYEGRELSEVIAELHGLRSDGKTLIAQPHVRGDKLWTLDDIKRLNCVFKNPVKAFN

SEQ ID NO: 11 - DNA, 1170 bp, Methylococcus capsulatus (Bath)
atgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataa

SEQ ID NO: 12 - protein, 389 aa, Methylococcus capsulatus (Bath)
MSMLGERRRGLTDPEMAAVILKALPEAPLDGNNKMGYFVTPRWKRLTEYEALTVYAQPNADWIAGGLDWGDWTQKFHGGRPSWGNETTELRTVDWFKHRDPLRRWHAPYVKDKAEEWRYTDRFLQGYSADGQIRAMNPTWRDEFINRYWGAFLFNEYGLFNAHSQGAREALSDVTRVSLAFWGFDKIDIAQMIQLERGFLAKIVPGFDESTAVPKAEWTNGEVYKSARLAVEGLWQEVFDWNESAFSVHAVYDALFGQFVRREFFQRLAPRFGDNLTPFFINQAQTYFQIAKQGVQDLYYNCLGDDPEFSDYNRTVMRNWTGKWLEPTIAALRDFMGLFAKLPAGTTDKEEITASLYRVVDDWIEDYASRIDFKADRDQIVKAVLAGLK

SEQ ID NO: 13 - DNA, 513 bp, Methylococcus capsulatus (Bath)
atggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactga

SEQ ID NO: 14 - protein, 170 aa, Methylococcus capsulatus (Bath)
MAKLGIHSNDTRDAWVNKIAQLNTLEKAAEMLKQFRMDHTTPFRNSYELDNDYLWIEAKLEEKVAVLKARAFNEVDFRHKTAFGEDAKSVLDGTVAKMNAAKDKWEAEKIHIGFRQAYKPPIMPVNYFLDGERQLGTRLMELRNLNYYDTPLEELRKQRGVRVVHLQSPH

SEQ ID NO: 15 - DNA, 6372 bp, Artificial Sequence
  Synthetic plasmid.
gctgcttctgaatcacgtgcgcggtgtcttcaaggccgtggccgtaaccgctccgggttttggcgacaaacgcccgaaccgtttacttgacctggccgcgttaaccggcggtcgtgccgtgctcgaagctcaaggcgaccgtctggaccgtgttaccctcgcggatctgggccgtgtgcgccgtgccgtggtgtcggcagatgataccgcgctgcttggcatcccgggcaccgaagctagccgtgcacgcctcgaaggtctgcgtttagaagcagagcagtaccgtgcgctgaaaccagggcagggttctgccaccgggcgcctgcacgaacttgaagaaattgaagcgcgcattgtgggtctgtccggaaagagcgccgtttatcgcgtcggaggtgtgaccgatgtggaaatgaaagagcgcatggttcgcatcgaaaacgcttaccgttcggtggtaagtgcgctggaggaaggcgtgctccctggcggtggtgtcggctttctgggtagtatgccggtgcttgcggaattggaggcccgcgacgcagatgaagctcgcgggattgggattgtacgcagcgccttaacggagcctcttcgtattatcggcgaaaatagtggcttgagcggtgaagccgttgttgccaaagtcatggatcatgccaacccgggatggggttacgaccaggagtctggctctttttgcgacctgcatgcgcgtgggatctgggatgctgctaaagtgttacgtctcgcgttggagaaggcagcctctgttgctgggacctttctgacaaccgaagctgttgttctcgaaattccggatacagatgcgttcgcagggttcagtgcagaatgggctgccgccacgcgcgaagatccgcgcgtatgagtttaaacgcggccgcaatttgaacgcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaagtttaaacgcggccgcaatttgaacgccagcacatggactcccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacggctagctcagtcctagggataatgctagcaccagcctcgagggaaaccacgtaagctccggcgtttaaacacccataacagatacggactttctcaaaggagagttatcagtgaaaatccgcccgttacatgaccgtgtcatcatcaaacgcttggaagaagagcgtacctcggcgggcgggattgtcattccagatagcgcagctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaatccgcgcacgacactgaacatacgaatttaaggaataaagataatggcgaaagaagttgtgtatcgtggtagtgcgcgccagcgtatgatgcagggtattgaaattctcgctcgcgccgctattccaacgctgggggcaaccggcccgagcgtcatgattcaacatcgcgccgatggtctgccacccatttctacacgcgatggcgttaccgtagcgaattctattgttttaaaagaccgtgtcgcgaacctgggtgcccgcctgctgcgcgacgtagccggtacaatgagccgtgaagccggcgacggcacgacgactgcgatcgtattggcccgccacatcgcccgtgagatgtttaaatcgctggccgtgggtgcagatccgatcgcgctgaaacgtggtatcgatcgcgccgttgctcgtgtgtccgaagatattggggcgcgtgcgtggcgtggcgataaagaaagcgtgatcctgggtgtcgctgctgtggcgacgaaaggcgaaccgggcgttggccgtctgctgctggaggctctcgatgcagtgggtgttcacggtgccgtttctatcgaactgggccaacgtcgtgaagatctgctggacgtcgtcgatggctatcgctgggaaaaaggttatttatctccctactttgtcacggaccgtgcccgcgaactcgcggaactggaggatgtctacctgctcatgaccgaccgcgaagtggttgacttcatcgaccttgtacctctgctggaggccgtgacggaagcaggaggctccctgctgattgccgcggatcgtgtgcacgaaaaggccttagcggg

SEQ ID NO: 16 - DNA, 11223 bp, Artificial Sequence
  Synthetic plasmid.
cgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcaacaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcgga

SEQ ID NO: 17 - DNA, 13270 bp, Artificial Sequence
  Synthetic plasmid.
atatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacggctagctcagtcctagggataatgctagcaccagcctcgagggaaaccacgtaagctccggcgtttaaacacccataacagatacggactttctcaaaggagagttatcagtgaaaatccgcccgttacatgaccgtgtcatcatcaaacgcttggaagaagagcgtacctcggcgggcgggattgtcattccagatagcgcagctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaatccgcgcacgacactgaacatacgaatttaaggaataaagataatggcgaaagaagttgtgtatcgtggtagtgcgcgccagcgtatgatgcagggtattgaaattctcgctcgcgccgctattccaacgctgggggcaaccggcccgagcgtcatgattcaacatcgcgccgatggtctgccacccatttctacacgcgatggcgttaccgtagcgaattctattgttttaaaagaccgtgtcgcgaacctgggtgcccgcctgctgcgcgacgtagccggtacaatgagccgtgaagccggcgacggcacgacgactgcgatcgtattggcccgccacatcgcccgtgagatgtttaaatcgctggccgtgggtgcagatccgatcgcgctgaaacgtggtatcgatcgcgccgttgctcgtgtgtccgaagatattggggcgcgtgcgtggcgtggcgataaagaaagcgtgatcctgggtgtcgctgctgtggcgacgaaaggcgaaccgggcgttggccgtctgctgctggaggctctcgatgcagtgggtgttcacggtgccgtttctatcgaactgggccaacgtcgtgaagatctgctggacgtcgtcgatggctatcgctgggaaaaaggttatttatctccctactttgtcacggaccgtgcccgcgaactcgcggaactggaggatgtctacctgctcatgaccgaccgcgaagtggttgacttcatcgaccttgtacctctgctggaggccgtgacggaagcaggaggctccctgctgattgccgcggatcgtgtgcacgaaaaggccttagcggggctgcttctgaatcacgtgcgcggtgtcttcaaggccgtggccgtaaccgctccgggttttggcgacaaacgcccgaaccgtttacttgacctggccgcgttaaccggcggtcgtgccgtgctcgaagctcaaggcgaccgtctggaccgtgttaccctcgcggatctgggccgtgtgcgccgtgccgtggtgtcggcagatgataccgcgctgcttggcatcccgggcaccgaagctagccgtgcacgcctcgaaggtctgcgtttagaagcagagcagtaccgtgcgctgaaaccagggcagggttctgccaccgggcgcctgcacgaacttgaagaaattgaagcgcgcattgtgggtctgtccggaaagagcgccgtttatcgcgtcggaggtgtgaccgatgtggaaatgaaagagcgcatggttcgcatcgaaaacgcttaccgttcggtggtaagtgcgctggaggaaggcgtgctccctggcggtggtgtcggctttctgggtagtatgccggtgcttgcggaattggaggcccgcgacgcagatgaagctcgcgggattgggattgtacgcagcgccttaacggagcctcttcgtattatcggcgaaaatagtggcttgagcggtgaagccgttgttgccaaagtcatggatcatgccaacccgggatggggttacgaccaggagtctggctctttttgcgacctgcatgcgcgtgggatctgggatgctgctaaagtgttacgtctcgcgttggagaaggcagcctctgttgctgggacctttctgacaaccgaagctgttgttctcgaaattccggatacagatgcgttcgcagggttcagtgcagaatgggctgccgccacgcgcgaagatccgcgcgtatgagtttaaacgcggccgcaatttgaacgcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaagtttaaacgcggccgcaatttgaacgccagcacatggactcccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggtgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgactatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatca

SEQ ID NO: 18 - DNA, 11223 bp, Artificial Sequence
  Synthetic plasmid.
cgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttctcgctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcaacaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgacgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcatggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggaggagcttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcgga

SEQ ID NO: 19 - DNA, 10075 bp, Artificial Sequence
  Synthetic plasmid.
ttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcggaccatggacttccgcgaccgggaactggtgtggatctggtcccgtctcaggcgggcccgaacctcccgcgccaatgccggggaggcctatatgcgccacctgtcgccggcggcgcgaaaaaacgaacaatcctgaaacggagtcgactcaacatggcaaaggaagtggtttacagggggagtgcgcggcagcgcatgatgcaaggcatcgagatactcgcgcgggcggcgataccgacgctgggagccaccggccccagcgtcatgatccagcaccgcgccgatggcctgccccccatttcgacgcgggacggcgtcacggtggctaactccatcgtactcaaggaccgtgtcgcgaatctcggtgcccggctgctgcgggacgtcgccggcaccatgtcccgcgaagcaggggatggcaccaccaccgccatcgtgctggcccgccatatcgcccgggagatgttcaagagcctcgccgtcggtgccgatcccatcgctctcaagcgtggtatcgaccgtgccgtcgcccgcgtgagcgaggacatcggggctcgggcctggcgcggcgacaaggaatcggtcatcctgggggtggccgcggtggcgaccaagggcgagccgggcgtgggccggctgctgctggaggcgctggacgcggtcggcgtccatggcgccgtgtcgatcgaactggggcagcggcgcgaggacctgctcgacgtggtcgacgggtatcgttgggaaaaaggttatctgtcgccctattttgtgaccgatcgggctcgcgagctggccgaactcgaagacgtctacctcttgatgaccgatcgggaggtggtcgatttcatcgatttggtacccctgctggaggcggtgaccgaggctggtggcagcctcctgatcgccgccgaccgtgtccacgagaaggcactggccggccttttgctcaatcacgttcgcggcgtcttcaaggccgtcgcggtcaccgcgcccgggttcggcgacaagcggccgaaccgccttttggatctggcggcgttgaccggtgggcgggcggtcctggaagcccagggcgaccgattggaccgggtcacgctggccgacctggggcgggtgcggcgggcggtcgtcagcgctgacgacaccgcgctgctcggcataccgggcaccgaagcctcccgggcccgcttggagggtttgcgcctggaagcggagcagtaccgggcgctcaagcccggtcagggatcggcgacggggcgcttgcacgagctcgaggaaatcgaggcccggatcgtcggtctgagcggcaagtccgcggtctaccgcgtgggcggcgtgaccgacgtggagatgaaggagcggatggtacggatcgaaaatgcctaccgctcggtggtgtctgcactggaggagggggtgttgcccggcggcggtgtcgggtttctgggcagcatgcccgttttggccgagctggaagcgcgcgatgccgacgaagcacgcggcatcggcatcgtccgttccgcgctgacggagcccctccggatcatcggagaaaattcgggactgtcaggggaggccgtcgtcgccaaggtcatggatcacgccaatcccggttggggttacgatcaggaaagcggaagtttctgcgacctccacgccaggggcatttgggatgccgccaaggtgctcaggctggccctggaaaaagccgcgtcggtggccggcacgtttctcaccaccgaagccgtggtactggagattccggacactgacgctttcgccggtttcagtgcggagtgggccgccgcgacccgggaggatccgcgggtctgagcggggggatacgccctcgaatcctgggatagtcagagaccggcatagcgtacgccgttacgcccgttctgcttgacctggtaaagttacaaccaattaaccaattctgagagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgcc

SEQ ID NO: 20 - DNA, 3621 bp, Artificial Sequence
  Synthetic plasmid.
cgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatgtccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaaattaatacgactcactataggggaattgtgagcggataacaattcccctgtagaaataattttgtttaactttaataaggagatataccatggcacatcaccaccaccatcacgtgggtaccggttcgaatgatgacgacgacaagagtccggatcccaattgggagctcgtgtacacggcgcgcctgcaggtcgacaagcttgcggccgcactcgagtctggtaaagaaaccgctgctgcgaaatttgaacgccagcacatggactcgtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaac

SEQ ID NO: 21 - DNA, 13173 bp, Artificial Sequence
  Synthetic plasmid.
taatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcggaccatggacttccgcgaccgggaactggtgtggatctggtcccgtctcaggcgggcccgaacctcccgcgccaatgccggggaggcctatatgcgccacctgtcgccggcggcgcgaaaaaacgaacaatcctgaaacggagtcgactcaacatggcaaaggaagtggtttacagggggagtgcgcggcagcgcatgatgcaaggcatcgagatactcgcgcgggcggcgataccgacgctgggagccaccggccccagcgtcatgatccagcaccgcgccgatggcctgccccccatttcgacgcgggacggcgtcacggtggctaactccatcgtactcaaggaccgtgtcgcgaatctcggtgcccggctgctgcgggacgtcgccggcaccatgtcccgcgaagcaggggatggcaccaccaccgccatcgtgctggcccgccatatcgcccgggagatgttcaagagcctcgccgtcggtgccgatcccatcgctctcaagcgtggtatcgaccgtgccgtcgcccgcgtgagcgaggacatcggggctcgggcctggcgcggcgacaaggaatcggtcatcctgggggtggccgcggtggcgaccaagggcgagccgggcgtgggccggctgctgctggaggcgctggacgcggtcggcgtccatggcgccgtgtcgatcgaactggggcagcggcgcgaggacctgctcgacgtggtcgacgggtatcgttgggaaaaaggttatctgtcgccctattttgtgaccgatcgggctcgcgagctggccgaactcgaagacgtctacctcttgatgaccgatcgggaggtggtcgatttcatcgatttggtacccctgctggaggcggtgaccgaggctggtggcagcctcctgatcgccgccgaccgtgtccacgagaaggcactggccggccttttgctcaatcacgttcgcggcgtcttcaaggccgtcgcggtcaccgcgcccgggttcggcgacaagcggccgaaccgccttttggatctggcggcgttgaccggtgggcgggcggtcctggaagcccagggcgaccgattggaccgggtcacgctggccgacctggggcgggtgcggcgggcggtcgtcagcgctgacgacaccgcgctgctcggcataccgggcaccgaagcctcccgggcccgcttggagggtttgcgcctggaagcggagcagtaccgggcgctcaagcccggtcagggatcggcgacggggcgcttgcacgagctcgaggaaatcgaggcccggatcgtcggtctgagcggcaagtccgcggtctaccgcgtgggcggcgtgaccgacgtggagatgaaggagcggatggtacggatcgaaaatgcctaccgctcggtggtgtctgcactggaggagggggtgttgcccggcggcggtgtcgggtttctgggcagcatgcccgttttggccgagctggaagcgcgcgatgccgacgaagcacgcggcatcggcatcgtccgttccgcgctgacggagcccctccggatcatcggagaaaattcgggactgtcaggggaggccgtcgtcgccaaggtcatggatcacgccaatcccggttggggttacgatcaggaaagcggaagtttctgcgacctccacgccaggggcatttgggatgccgccaaggtgctcaggctggccctggaaaaagccgcgtcggtggccggcacgtttctcaccaccgaagccgtggtactggagattccggacactgacgctttcgccggtttcagtgcggagtgggccgccgcgacccgggaggatccgcgggtctgagcggggggatacgccctcgaatcctgggatagtcagagaccggcatagcgtacgccgttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgc

SEQ ID NO: 22 - DNA, 11223 bp, Artificial Sequence
  Synthetic plasmid.
taatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgc

SEQ ID NO: 23 - DNA, 6963 bp, Artificial Sequence
  Synthetic plasmid.
ccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatttcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcaattgaccaacaaggacactaattactgttaggaggttgttcatgaaagccgccgtggtcgagcaattcaaaaaaccactccaggtgaaagaggtcgaaaaaccgaaaattagttacggtgaagtgctggttcgtattaaagcttgtggtgtctgccacaccgatctgcatgccgcacacggcgattggccggtaaaaccgaaactgccgctcatccccggccatgaaggcgtaggcgtcatcgaggaagtcggcccgggtgtgacacaccttaaagttggcgatcgtgtgggcattccctggctgtattcggcgtgtggccactgtgactattgtctcagcggccaggagactctgtgcgaacgccagcagaacgccggctacagcgttgatggtggctacgccgagtactgtcgtgctgcggcagattacgtggtgaagattcctgataatctttcctttgaagaagcggcgcccattttatgcgcgggcgttaccacttataaagcgctgaaagtcaccggtgccaaaccaggcgagtgggtggccatttatggaattgggggcctcggccatgtggcagttcagtacgctaaagcaatgggcttaaacgtcgtggcagtggacttgggagatgaaaagctggaactggcaaaacaactgggcgcggacctggtagtgaatccgaaacatgatgatgcagcacaatggattaaagaaaaagttggtggcgtgcatgccacggtggtgacggcagttagtaaagccgcttttgaatcggcgtataagtcaatccgccgcggaggagcatgcgtccttgttggtctgccaccggaggaaatccccattccgatttttgacacagttctgaacggcgtcaaaattatcggttcaattgttggcacccgtaaagacctgcaggaagccctccagtttgctgctgaaggcaaagtgaaaactatcgtggaagttcagccgcttgagaacattaacgacgtatttgatcgtatgctgaaaggacagattaatggacgtgtggtcctgaaagtggattgacatgctaaggtgctggctgcatgctaagttgatacgcctgcttcaaagtctactaggaggataagaatggagatcatggataaggatttacagagcatccaggaagtacgcacccttatcgcaaaggctaagaaagcacaggccgaatttaagaacttctctcaagaggcggttaacaaagtcattgagaagatcgcaaaagccacggaggtagaggccgtgaagcttgcgaagttagcttatgaggatacaggatacggtaaatgggaggacaaggtaattaaaaacaaattttcctctatcgtagtatacaactatattaaagaccttaagacggtaggtattttgaaagaggataaagaaaagaagcttatcgacatcgcggtaccattgggggtaatcgcgggccttattccaagtacgaaccctactagcaccgcgattttcaaggtattaattgcattgaaggcgggcaatgccattgtgttcagccctcacccaacggcggttcgtagcattactgagaccgtcaaaatcatgcaaaaagcggcggtcgaagcaggtgctcctgatggattaattcagtgcatgtcgattttaactgtcgaaggaaccgctgaattgatgaagaacaaggataccgcactgattttagccaccgggggcgagggaatggtacgtgctgcctacagttcaggcacgcctgcgatcggtgtggggcccggcaatggcccttgctttattgagcgcaccgctgacattcctacggctgtccgcaaagtgattggctcggatacattcgataatggtgtgatctgcgcatcggagcaaagtattatcgcagagacggttaaaaaggccgagatcattgaagaattcaaacgtcagaaaggttatttcttgaacgccgaagaatcagagaaagtgggaaagattttattgcgcgccaacgggacacctaacccagcgatcgtgggaaaggatgtccaagcattagccaagttagcaggtatttcgatcccgagcgacgcggttatcctgttatctgaacagacggacgtatcgcccaagaatccgtatgcaaaagagaaactggccccggtcttagctttttacactgtggaagattggcatgaagcctgtgagaagtcattggcccttttgcataaccaaggaagcgggcataccttaatcattcattctcagaacgaggaaattatccgcgagtttgcgcttaaaaagccagtaagtcgtatcttggttaacagccccggctcacttggaggaattggaggcgctacgaatttagtcccaagcctgactttagggtgcggtgcagtcggtggttcagccaccagcgataatgttggtccggagaatttatttaatatccgcaaggtggcttatggtacgacaaccgttgaagaaattcgtgaggccttcggagtgggtgcagccagctcaagtgcgcccgccgagccggaggacaatgaagacgttcaagcaattgtgaaagcaatcatggccaagcttaatttgtaagtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttcggtccgttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttccttaggactgagcgtcaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatataaggtgcactgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgaaatt

SEQ ID NO: 24 - DNA, 3826 bp, Artificial Sequence
  Synthetic plasmid.
ttcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaaccccaaaaaaacgggtatggagaaacagtagagagttgcgataaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggtttggttagcgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaatgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtttgccgaccgggtgatattttgctgttcccgccaggagagattcatcactacggtcgtcatccggaggctcgcgaatggtatcaccagtgggtttactttcgtccgcgcgcctactggcatgaatggcttaactggccgtcaatatttgccaatacggggttctttcgcccggatgaagcgcaccagccgcatttcagcgacctgtttgggcaaatcattaacgccgggcaaggggaagggcgctattcggagctgctggcgataaatctgcttgagcaattgttactgcggcgcatggaagcgattaacgagtcgctccatccaccgatggataatcgggtacgcgaggcttgtcagtacatcagcgatcacctggcagacagcaattttgatatcgccagcgtcgcacagcatgtttgcttgtcgccgtcgcgtctgtcacatcttttccgccagcagttagggattagcgtcttaagctggcgcgaggaccaacgtatcagccaggcgaagctgcttttgagcaccacccggatgcctatcgccaccgtcggtcgcaatgttggttttgacgatcaactctatttctcgcgggtatttaaaaaatgcaccggggccagcccgagcgagttccgtgccggttgtgaagaaaaagtgaatgatgtagccgtcaagttgtcataattggtaacgaatcagacaattgacggcttgacggagtagcatagggtttgcagaatccctgcttcgtccatttgacaggcacattatgcatgccgcttcgccttcgcgcgcgaattgatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcacctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgca

SEQ ID NO: 25 - DNA, 13007 bp, Artificial Sequence
  Synthetic plasmid.
atcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaaggtttattgactaccggaagcagtgtgaccgtgtgcttctcaaatgcctgaggtttcagcaaaaaacccctcaagacccgtttagaggccccaaggggttatgctagttattgctcagcggtggcagcagagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcggaccatggacttccgcgaccgggaactggtgtggatctggtcccgtctcaggcgggcccgaacctcccgcgccaatgccggggaggcctatatgcgccacctgtcgccggcggcgcgaaaaaacgaacaatcctgaaacggagtcgactcaacatggcaaaggaagtggtttacagggggagtgcgcggcagcgcatgatgcaaggcatcgagatactcgcgcgggcggcgataccgacgctgggagccaccggccccagcgtcatgatccagcaccgcgccgatggcctgccccccatttcgacgcgggacggcgtcacggtggctaactccatcgtactcaaggaccgtgtcgcgaatctcggtgcccggctgctgcgggacgtcgccggcaccatgtcccgcgaagcaggggatggcaccaccaccgccatcgtgctggcccgccatatcgcccgggagatgttcaagagcctcgccgtcggtgccgatcccatcgctctcaagcgtggtatcgaccgtgccgtcgcccgcgtgagcgaggacatcggggctcgggcctggcgcggcgacaaggaatcggtcatcctgggggtggccgcggtggcgaccaagggcgagccgggcgtgggccggctgctgctggaggcgctggacgcggtcggcgtccatggcgccgtgtcgatcgaactggggcagcggcgcgaggacctgctcgacgtggtcgacgggtatcgttgggaaaaaggttatctgtcgccctattttgtgaccgatcgggctcgcgagctggccgaactcgaagacgtctacctcttgatgaccgatcgggaggtggtcgatttcatcgatttggtacccctgctggaggcggtgaccgaggctggtggcagcctcctgatcgccgccgaccgtgtccacgagaaggcactggccggccttttgctcaatcacgttcgcggcgtcttcaaggccgtcgcggtcaccgcgcccgggttcggcgacaagcggccgaaccgccttttggatctggcggcgttgaccggtgggcgggcggtcctggaagcccagggcgaccgattggaccgggtcacgctggccgacctggggcgggtgcggcgggcggtcgtcagcgctgacgacaccgcgctgctcggcataccgggcaccgaagcctcccgggcccgcttggagggtttgcgcctggaagcggagcagtaccgggcgctcaagcccggtcagggatcggcgacggggcgcttgcacgagctcgaggaaatcgaggcccggatcgtcggtctgagcggcaagtccgcggtctaccgcgtgggcggcgtgaccgacgtggagatgaaggagcggatggtacggatcgaaaatgcctaccgctcggtggtgtctgcactggaggagggggtgttgcccggcggcggtgtcgggtttctgggcagcatgcccgttttggccgagctggaagcgcgcgatgccgacgaagcacgcggcatcggcatcgtccgttccgcgctgacggagcccctccggatcatcggagaaaattcgggactgtcaggggaggccgtcgtcgccaaggtcatggatcacgccaatcccggttggggttacgatcaggaaagcggaagtttctgcgacctccacgccaggggcatttgggatgccgccaaggtgctcaggctggccctggaaaaagccgcgtcggtggccggcacgtttctcaccaccgaagccgtggtactggagattccggacactgacgctttcgccggtttcagtgcggagtgggccgccgcgacccgggaggatccgcgggtctgagcggggggatacgccctcgaatcctgggatagtcagagaccggcatagcgtacgccgttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgcaacgcaattaatgtaagttagctcactcattaggcaccgggatctcgaccgatgcccttgagagccttcaacccagtcagctccttccggtgggcgcggggcatgactaacatgagaattacaacttatatcgtatggggctgacttcaggtgctacatttgaagagataaattgcactgaaatctagagcggttcagtagaaaagatcaaaggatcttcttgagatcctttttttctgcgcgtaatcttttgccctgtaaacgaaaaaaccacctggggaggtggtttgatcgaaggttaagtcagttggggaactgcttaaccgtggtaactggctttcgcagagcacagcaaccaaatctgtccttccagtgtagccggactttggcgcacacttcaagagcaaccgcgtgtttagctaaacaaatcctctgcgaactcccagttaccaatggctgctgccagtggcgttttaccgtgcttttccgggttggactcaagtgaacagttaccggataaggcgcagcagtcgggctgaacggggagttcttgcttacagcccagcttggagcgaacgacctacaccgagccgagataccagtgtgtgagctatgagaaagcgccacacttcccgtaagggagaaaggcggaacaggtatccggtaaacggcagggtcggaacaggagagcgcaagagggagcgacccgccggaaacggtggggatctttaagtcctgtcgggtttcgcccgtactgtcagattcatggttgagcctcacggctcccacagatgcaccggaaaagcgtctgtttatgtgaactctggcaggagggcggagcctatggaaaaacgccaccggcgcggccctgctgttttgcctcacatgttagtcccctgcttatccacggaatctgtgggtaactttgtatgtgtccgcagcgcccgccgcagtctcacgcccggagcgtagcgaccgagtgagctagctatttgtttatttttctaaatacattcaaatatgtatccgctcatgagacaataaccctgataaatgcttcaataatattgaaaaaggaagagtatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgaggggccgcaagatccggccacgatgacccggtcgtcggttcagggcagggtcgttaaatagccgcttatgtctattgctggtttaccggctagctcagtcctaggtacaatgctagcggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggct

SEQ ID NO: 26 - DNA, 9915 bp, Artificial Sequence
  Synthetic plasmid.
acaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcggaccatggacttccgcgaccgggaactggtgtggatctggtcccgtctcaggcgggcccgaacctcccgcgccaatgccggggaggcctatatgcgccacctgtcgccggcggcgcgaaaaaacgaacaatcctgaaacggagtcgactcaacatggcaaaggaagtggtttacagggggagtgcgcggcagcgcatgatgcaaggcatcgagatactcgcgcgggcggcgataccgacgctgggagccaccggccccagcgtcatgatccagcaccgcgccgatggcctgccccccatttcgacgcgggacggcgtcacggtggctaactccatcgtactcaaggaccgtgtcgcgaatctcggtgcccggctgctgcgggacgtcgccggcaccatgtcccgcgaagcaggggatggcaccaccaccgccatcgtgctggcccgccatatcgcccgggagatgttcaagagcctcgccgtcggtgccgatcccatcgctctcaagcgtggtatcgaccgtgccgtcgcccgcgtgagcgaggacatcggggctcgggcctggcgcggcgacaaggaatcggtcatcctgggggtggccgcggtggcgaccaagggcgagccgggcgtgggccggctgctgctggaggcgctggacgcggtcggcgtccatggcgccgtgtcgatcgaactggggcagcggcgcgaggacctgctcgacgtggtcgacgggtatcgttgggaaaaaggttatctgtcgccctattttgtgaccgatcgggctcgcgagctggccgaactcgaagacgtctacctcttgatgaccgatcgggaggtggtcgatttcatcgatttggtacccctgctggaggcggtgaccgaggctggtggcagcctcctgatcgccgccgaccgtgtccacgagaaggcactggccggccttttgctcaatcacgttcgcggcgtcttcaaggccgtcgcggtcaccgcgcccgggttcggcgacaagcggccgaaccgccttttggatctggcggcgttgaccggtgggcgggcggtcctggaagcccagggcgaccgattggaccgggtcacgctggccgacctggggcgggtgcggcgggcggtcgtcagcgctgacgacaccgcgctgctcggcataccgggcaccgaagcctcccgggcccgcttggagggtttgcgcctggaagcggagcagtaccgggcgctcaagcccggtcagggatcggcgacggggcgcttgcacgagctcgaggaaatcgaggcccggatcgtcggtctgagcggcaagtccgcggtctaccgcgtgggcggcgtgaccgacgtggagatgaaggagcggatggtacggatcgaaaatgcctaccgctcggtggtgtctgcactggaggagggggtgttgcccggcggcggtgtcgggtttctgggcagcatgcccgttttggccgagctggaagcgcgcgatgccgacgaagcacgcggcatcggcatcgtccgttccgcgctgacggagcccctccggatcatcggagaaaattcgggactgtcaggggaggccgtcgtcgccaaggtcatggatcacgccaatcccggttggggttacgatcaggaaagcggaagtttctgcgacctccacgccaggggcatttgggatgccgccaaggtgctcaggctggccctggaaaaagccgcgtcggtggccggcacgtttctcaccaccgaagccgtggtactggagattccggacactgacgctttcgccggtttcagtgcggagtgggccgccgcgacccgggaggatccgcgggtctgagcggggggatacgccctcgaatcctgggatagtcagagaccggcatagcgtacgccgttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcaggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgcagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcct

SEQ ID NO: 27 - DNA, 6963 bp, Artificial Sequence
  Synthetic plasmid.
ccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatttcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcaattgaccaacaaggacgtcaatagagttaaggagggaggggatgaaagccgccgtggtcgagcaattcaaaaaaccactccaggtgaaagaggtcgaaaaaccgaaaattagttacggtgaagtgctggttcgtattaaagcttgtggtgtctgccacaccgatctgcatgccgcacacggcgattggccggtaaaaccgaaactgccgctcatccccggccatgaaggcgtaggcgtcatcgaggaagtcggcccgggtgtgacacaccttaaagttggcgatcgtgtgggcattccctggctgtattcggcgtgtggccactgtgactattgtctcagcggccaggagactctgtgcgaacgccagcagaacgccggctacagcgttgatggtggctacgccgagtactgtcgtgctgcggcagattacgtggtgaagattcctgataatctttcctttgaagaagcggcgcccattttatgcgcgggcgttaccacttataaagcgctgaaagtcaccggtgccaaaccaggcgagtgggtggccatttatggaattgggggcctcggccatgtggcagttcagtacgctaaagcaatgggcttaaacgtcgtggcagtggacttgggagatgaaaagctggaactggcaaaacaactgggcgcggacctggtagtgaatccgaaacatgatgatgcagcacaatggattaaagaaaaagttggtggcgtgcatgccacggtggtgacggcagttagtaaagccgcttttgaatcggcgtataagtcaatccgccgcggaggagcatgcgtccttgttggtctgccaccggaggaaatccccattccgatttttgacacagttctgaacggcgtcaaaattatcggttcaattgttggcacccgtaaagacctgcaggaagccctccagtttgctgctgaaggcaaagtgaaaactatcgtggaagttcagccgcttgagaacattaacgacgtatttgatcgtatgctgaaaggacagattaatggacgtgtggtcctgaaagtggattgacatgctaaggtgctggctgcatgctaagttgatacgcctgcgacaaatttttctaggagcgttagtatggagaacatggataaggatttacagagcatccaggaagtacgcacccttatcgcaaaggctaagaaagcacaggccgaatttaagaacttctctcaagaggcggttaacaaagtcattgagaagatcgcaaaagccacggaggtagaggccgtgaagcttgcgaagttagcttatgaggatacaggatacggtaaatgggaggacaaggtaattaaaaacaaattttcctctatcgtagtatacaactatattaaagaccttaagacggtaggtattttgaaagaggataaagaaaagaagcttatcgacatcgcggtaccattgggggtaatcgcgggccttattccaagtacgaaccctactagcaccgcgattttcaaggtattaattgcattgaaggcgggcaatgccattgtgttcagccctcacccaacggcggttcgtagcattactgagaccgtcaaaatcatgcaaaaagcggcggtcgaagcaggtgctcctgatggattaattcagtgcatgtcgattttaactgtcgaaggaaccgctgaattgatgaagaacaaggataccgcactgattttagccaccgggggcgagggaatggtacgtgctgcctacagttcaggcacgcctgcgatcggtgtggggcccggcaatggcccttgctttattgagcgcaccgctgacattcctacggctgtccgcaaagtgattggctcggatacattcgataatggtgtgatctgcgcatcggagcaaagtattatcgcagagacggttaaaaaggccgagatcattgaagaattcaaacgtcagaaaggttatttcttgaacgccgaagaatcagagaaagtgggaaagattttattgcgcgccaacgggacacctaacccagcgatcgtgggaaaggatgtccaagcattagccaagttagcaggtatttcgatcccgagcgacgcggttatcctgttatctgaacagacggacgtatcgcccaagaatccgtatgcaaaagagaaactggccccggtcttagctttttacactgtggaagattggcatgaagcctgtgagaagtcattggcccttttgcataaccaaggaagcgggcataccttaatcattcattctcagaacgaggaaattatccgcgagtttgcgcttaaaaagccagtaagtcgtatcttggttaacagccccggctcacttggaggaattggaggcgctacgaatttagtcccaagcctgactttagggtgcggtgcagtcggtggttcagccaccagcgataatgttggtccggagaatttatttaatatccgcaaggtggcttatggtacgacaaccgttgaagaaattcgtgaggccttcggagtgggtgcagccagctcaagtgcgcccgccgagccggaggacaatgaagacgttcaagcaattgtgaaagcaatcatggccaagcttaatttgtaagtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttcggtccgttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttccttaggactgagcgtcaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatataaggtgcactgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgaaatt

SEQ ID NO: 28 - DNA, 10103 bp, Artificial Sequence
  Synthetic plasmid.
ctcgagggtgttttcacgagcaattgaccaacaaggacgtttaaacataaaggaggaatataatgagtcgtcaatctatgtcgaaagcccataaaaagatcacagagctgtcctgggagccgacgtttgccactcccgccaaacgttttggtaccgactacacatttgacaatgctccgaaaaaagatcctctgaagcagattttacgctcgtactttcccatggaggaggaaaaagattcacgcgttttcggagcgatggacggggccatccgtggtaatatgtttcgccaggtgcaggagcgttggatggagtggcagaagttgtttctgtcaattatcccgtttcctgaaatctccgcggcacgtgccatgccaatggcgattgacgccgtgcccaacccagagattcataatggtttagctgttcagatgattgatgaagtgcgtcattcgacgatccaaatgaacctgaaacgcctgtacatgaattactacatcgatccagcgggttttgatatgaccgaaaaagctttcgcaaataactacgctggtacaattggccgtcaatttggcgaaggttttattacaggggatgcgatcacggcagccaatatctaccttactgtggttgcagaaactgcattcaccaacacgctgtttgtggcgatgccgagcgaagctgcggccaatggagactatctgctgccaactgtgttccacagtgtccagagtgatgaatctcgtcatatttcaaacggttactccatccttctgatggcgttgtcggacgaggataaccgtcagctgttagaacgtgatcttcgctatgcctggtggaacaaccaccgcgtcgttgacgccgcgattggaaccttcattgaatatggtaccaaagatcgtcgcaaagaccgtgagtcgtatgcggaaatgtggcgtcgctggatttatgacgattattatcgtgcgtatctgattccgctggagaaatacgggcttgtgatcccacacgatctgatcgaggagtcgtggaaacaaatttgggagaaaggctatgtccatgaggtcgcccagttttttgcgacaggctggcttgcgaattattggcgcattgattccatgactgatgaagatttcgaatggttcgaatacaagtatcctggctggtatgataaatatggtaaatggtgggaaaactataatcgcctgagcaaaccgaacggccacaatccgattgtgtttgaagatgtagattatgtgtacccggcacgctgttggacgtgcatgagcccctgctggtcagtccgcacactcgttacggcggaagttgatggccaacatcgcacctattgccacgaagtatgtcgttggacggatgtgcgtgggttcccatccgatgtgccgggtcgtgaaaccccaaatatgggtcgcttagtgggtaaacgtgagtgggaaacgttgtaccacggttggaattgggcagatgttgtttcggatatggggtttgtacgtgatgacgggaagacgatgaccccgaaaccgcatctggatctggatccaaaaaaaatgtggaccctcgatcacatgcgtcgctgtccgcccctgcagtcgccgaatgtactgtttaacgaaatgtccgacgcggagcgtgctgcctatgtcgcggactacaacaaacagggccctgctggtcgtccggccccgcaatcgtaaatataggaggataataatgggagataaacatgtagtccgttttgaaccggtgggtatcgaaattgaagttgatgaagatcagaccatcctgcgtgcagcagccgaacagggtgtgcagctgatgcacggctgcaaagaaggtcagtgtgcggcctgcaaaagctttgttctggaaggtgaggatattgagctggacagttactctatttttacactgccagattacgagaaagaggagggatcgacgttgctgtgtcgtgcgcatgcctatgaagacttgaccattgaactgttgaactatgatgaagaaattattcgcagcggtctgccgctgcgtaaaggtaaggtccaggtagtagcaaatgatgaagttacccatgacctgcgtcgtctggtagtaaaactgattgaaccggaagagattaaatttttccccggacagtacatggatttcatcgttccaggaactgaagagtcgcgtagcttctcaatggccaatacaccaaaccgtgaaggcgaattcgaatttgtgatcaagatttatccagatggcctttttagtgaatttctggccgagaaagttcaagtgggtgatcagctggaagtggaagcgccgtttggcacttttaccttacgcgagaaccgtacgtcagatatcgtttttgtgggcggcggcgcgggtatggcgccaatcctgggtctgctgcgttctatggcagaacgtggcgtggaacgccgcgcccgcttctattacggcgcgcgtgcgacacgcgacctttgctttgccgaagaaattgccgcgctgggtgaacagctgccgagtggccttacatataccccggcgctgagccatcctgacgacgaaccgtggagcggccagaccggcctgatcaccgaggtgttacaggccaatgaaagtacactggagggcgcggatgcctacgtatgtggtccaccaccaatggtcgacgccgcgattgcgacccttaccgcccttggtgtgcgtgaggaaaacattttctatgataaatttaccacccaccgctgaaataaggaggatattaatgacgaccacagaacgtccggaacgttccgtgcctaaacctgtgttcaccgatgcggaggcaggcgcccacgagtttcctgatagcggagcatccgcgcgccgttataattactataactcaatcaacgcaagccgtacgcactatgaagatgtaacggtggatgtgcagccggatccgcgtcattatttgtcgcagggctggatctacgggttcgcggatggatctgcacgctaccctctgacctggacgaaattgaaagccgtgggccgtggctcggcgcgcgcgcgtgcattacctcgtttacgtcgtcagggccttcgcgtctgtccgccgaccgcttggcatgaatttcgcgacccaaacgaggagtgggaattgaccttttatcgctataacgctaatgtggtgcgccaggttaaccagaatattgaaaatgcccgctatgcgaaagcgttcgaacagtggacacccaactggattcagttcgtggaacgtaatgtcggcgcctggatgcacattgagcatacgttgggcctgtatgtcttcgctgcctgcaatcgttctgggcctactaacatgcacaataccgcaatggcgtacaccgcttgccataaaattcgttttgcacaggatcttgcactgtataacttaaccctcactgaagaaattgaaggcttcgatggaactgcacatttggaggcgtggaacagcgatccggagtggcaggccagtggtcgcagtcatgaagcgctgaccgccgtggatgacgactggggcgaaagtatttttgccacgaatgtggtgttcgaaccgttgcttcgcgagctgtttcgcagtaaccttgttatgcaggcggctgccggtaacggtgatttcgttaccccgacggtgatgggcgcggcggaatttgattttgcgcaacgtgacttacgttggacccaagcttgttttggtcccttaacccaagataaggaatttgccgattataacaaagatctcatgcaaggatggctgtctcattgggttccgcaggctatcgaagcggctcgcgttttgcagccgatctggtcgctgccagacgctaaaccaccgcgctttgaagattcattagaccgtgcaaaaagccgttttagcggtattgtaacggacttagggttatctgtgccgaaggaactgtcacaataaatttaggaggaatattatgacgtcttttaagacggcagaatctccctttaaagcagataacacggcttcgggaaaggctggcgtgacccttatgaacaatcaaattggtgtggtggttgcagaagtaatggatcagcaagaaaatgtaaccattacacacttgccgagtatgattcgtgttgactgtgtgggtcgcatggattttgtgtatgacgatatctcggaagcgctgggcgaggagccggggttttacgacgctgcggaattcgaagaaaacatgagcacccattacgggaagatgattcacatggatgaccgtactgtaatgtttgggaacttagaagaagccgcagaattcattggtgatatgctgccgcctccggttaaataataagtttaaacggatacgccctcgaatcctgggatagcggccgctcagtgaccggcatagcgtacgcctcgagttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggat

SEQ ID NO: 29 - DNA, 10025 bp, Artificial Sequence
  Synthetic plasmid.
ccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatctcgagggagagcaggacctccgctgtgactcttcttttttttcttttattctcactacatacattttagttattcgccaacatggctatgcaccctcgaaaggactggtatgagttgacaagagcaacaaactggacgccatcctatgtgacagaagaacaattgttcccagagcgtatgtcaggacatatgggcatacccttggaaaaatgggagtcatacgatgagccttataagacttcttacccagagtatgtttccatccaaagagaaaaagatgccggtgcctattccgtgaaagctgctttagaaagagctaagatctacgaaaattcagatcctggatggatctctactctgaagtcacactatggggcaattgccgtgggcgaatacgctgctgtcacaggagagggacgtatggccagattttcaaaagcacccggaaacagaaatatggctacatttggtatgatggatgaattaagacatggtcagctgcagttattctttcctcatgaatactgtaaaaaggacagacaattcgattgggcctggagagcctaccattcaaacgaatgggccgcaattgctgctaaacatttctttgacgatatcattactggacgtgatgcaataagtgtcgccatcatgttaactttttcttttgaaacaggcttcactaacatgcaattcttaggattggctgcagacgctgctgaagctggcgactatacattcgctaatttgatatcttcaattcagacagatgagtccagacacgctcaacagggtggtcctgctctgcaacttttgatcgaaaatggtaagagagaagaagcacagaagaaagttgacatggctatatggagagcttggcgtttatttgccgtacttactggtccagtaatggactattacactccattagaagacagatcacagtcttttaaggaatttatgtacgagtggatcataggccagtttgaaagatccctgattgacttgggccttgacaaaccttggtattgggatttattccttaaggatattgatgaactacaccactcttaccatatgggagtttggtactggagaacaacagcttggtggaaccccgctgccggagttacacccgaagaaagggactggttggaggaaaagtatccaggttggaataaacgttggggaagatgttgggacgtaataactgaaaacgtgttgaacgacagaatggatctggtaagtcctgaaactctgccatcagtctgcaacatgtctcaaatccctctagttggtgtgccaggagacgattggaacatagaagttttttctttagagcacaatgggcgactttatcacttcggatcagaggttgacagatgggttttccaacaagacccagtccaataccaaaaccatatgaatatagttgacaggtttttggcaggtcaaatccagcctatgaccttagagggagctttaaagtacatgggctttcagtctattgaggaaatgggaaaagacgctcatgattttgcctgggccgataagtgtaagccagcaatgaaaaaaagtgcataagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatgtcagcttttcccgtgcacgcagctttcgagaaagactttttggtacaactggttgtagtggatcttaacgattcaatggatcaggtcgccgaaaaggttgcataccattgtgttaacaggagggttgctcctagggaaggagtaatgagagttcgtaagcacaggtccacagaattgtttccaagagatatgactatagccgaatctggtctgaatccaaccgaggttattgacgttgtattcgaggaataaattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatgtctttcgaaaaaatctgctcattagacgatatttgggtcggagagatggagacatttgagacgtccgatggaactgaggtcctgattgttaattccgaggaacatggtgtgaaggcttaccaagccatgtgccctcatcaggagatattgttgagtgaaggaagttacgagggaggggtcataacttgcagggctcatttgtggacttttaatgatggtactggtcatggtataaaccctgatgactgttgtttggctgagtaccctgttgaggtaaaaggcgatgatatttacgtctctactaagggtattttgccaaacaaggctcactcctagagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgag

SEQ ID NO: 30 - DNA, 10271 bp, Artificial Sequence
  Synthetic plasmid.
ttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttatgggtaccaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgcggccgctcttaagggtgatgtagccctcgccgtttttcgaatagctgtagatacattgacgggaacaaagagaaactctaagggatacactctatcattggtgaaaaagtttatttcaattgttgacggctttgaagttcttgacagagattaccttgtttcctcgattgtaactcacatgtcctcattggatcccaaatgttcggagtatattgttattgctttagcgcttccattgcgatatttgtctatttcgtcaccagagtttccaatcaagctgcagctgtctgtcaagaattatctaaagctagatgagccctcaactagaaatggctatgttgagtttttaaccaaacttttggaagcatgtagaaacgaagaaaatgatacaagagctgttttactacaacaattagtaaagaaatgcaaatgttctgtgtgatagcctttcttttttgaattcagcatgttggtttatggtgttttattgaagccatgactgagcctttttacttagatgaccacatgacttatgagacgtcaattaaggaggaccagtagaataagatcgcaatagtttctgctgtcatgatgaagcgtatatacagagccaaatcttcatgcatacaataacatattgtgtttcctcccaaataattaacaatgacttacctgtatatccaggacactcctgtactgagaccgaccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgatgtactgagaccgctctgtgctctagtattgataattggtctactactagatagatgcctaacattaatgatatagtcgtatcagtctttgctgtaaataaagcctccggaatgagatctaaagaatcagcccagatgtttggaaggagggaaagatacgcctttctactaattaagccagttttgatctcagttgattgatgtcctgtctctgcgatagctcaaaactggcaactgaaacagatagtatattaattttcagttgctaatgataagccattgtaacattcctatcacatcggccgtttgcctcttttttgggaaaactctttccagtgaatgcacagcttatcgctttcaatgcttcaaaggcaacttccctactaagacactaaatatatatacatcaatgaacatatagtgggaaaaatggtagtgaagaagtagtcatttgtttgaatataagttggctgtacatgtgcctccgtagtctgtggccgagcttcatccacctagcaattgaaactgaagagctaagctcttcatattctcattcggttctgttattctcttttacttcttcttgtcaaaatattatgtattatgtgtagtacccgaccaacatggagaattcaatctaagaaatagatgtcaccccaagccgaacaaaaacaaccggtgaagaaaacgtaactgagtgaatggaattgtgattcaagcaattagagtaattgaatttcacttctggtacgagaaataaagtgaaaaacaaaatacctccgcataattagtgacgaaaaaaaccacacgtatactattcactgagtgaaagtgcgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatctcgagggagagcaggacctccgctgtgactcttcttttttttcttttattctcactacatacattttagttattcgccaacatgtcaactctggctgaccaggccctacacaataacaacgtcggtccaataattagagctggcgatttggtcgaacctgtgatcgaaaccgctgagattgataatcctggtaaggagatcacagttgaagacagaagagcttacgtcagaatcgctgctgaaggggagttgatattgacaagaaagactctggaagaacaattagggaggccattcaacatgcaagagcttgaaattaacttagctagttttgccggtcaaattcaggcagatgaagatcaaatcaggttctattttgataaaactatgtaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatgtctttcgaatctaagaagcctatgagaacttggtcacatcttgctgagatgcgtaaaaagccttccgagtacgatatagtttcaagaaagttgcattactctactaataacccagattccccatgggagctatctccagattctcctatgaatttatggtacaaacaatatagaaacgcttcccctctgaaacacgacaactgggatgctttcacagacccagatcaacttgtttatcgtacatataatctgatgcaagatggccaggaatcatatgtccaaagtcttttcgaccagtttaacgaaagggaacatgaccaaatggtacgtgaaggttgggaacacactatggccagatgttactccccattgcgttacttgtttcactgcttgcagatgtcctctgcttatgtccagcagatggctcccgcctcaacaatatctaattgctgtattttgcagactgctgattctctgaggtggttaacgcacacagcttacaggacgcacgagttgtctttgacttacccagatgctggtttgggcgagcacgagagagaactgtgggaaaaggaacctggatggcagggattgcgagagcttatggagaagcagttgaccgcatttgattggggagaggctttcgtttcccttaatttagttgttaagcctatgattgtcgaatccatttttaaaccactgcagcaacaggcttgggaaaacaacgacactttgttgccattattaatcgattctcaattaaaagacgctgagcgtcatagtaggtggtcaaaggctctggtgaagcatgcccttgaaaatccagataatcatgctgtcattgaaggatggatcgaaaaatggaggccattggctgaccgtgctgccgaagcctacttatccatgctgtcctccgacatcttgccagcccaatacttagagagatcaacctcattgagggcctcaatactgactgtttagattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatgttcaacatccaatctgatgatctgttgcatcatttcgaggcagattctaacgatacattactgtccgccgccttgcgtgccgaattggtatttccttatgaatgcaactctggaggatgcggcgcatgtaagatagaattgttggaaggggaagtctcaaacttatggccagacgcacctggtctagccgcccgtgagttgagaaaaaacaggtttttggcttgccagtgcaaacccttgagtgatctgaaaattaaagttattaacagagccgaagggagagctagtcatccacctaaaagatttagtaccagggtagtctctaagcgttttttgtccgatgaaatgtttgagcttagactagaggctgaacagaaggtcgtgttctctcctggtcaatactttatggttgatgtgcctgaactgggtacccgtgcctactccgctgctaatccagttgacgggaatactctgacacttattgtgaaagccgttcctaacggtaaagtatcttgcgccctggctaatgaaacgatagaaacattgcagttggatggtccttacggtttgtccgtcctgaaaaccgctgatgaaacacaatcagttttcattgctggaggctccggtattgctcctatggtttccatggttaatacacttattgctcaaggctacgagaaaccaattacggtcttttatggatctagattagaagcagagttggaggctgcagagactttattcggatggaaagaaaatttgaaattaatcaatgtctcttcttcagttgttggtaattctgagaagaaatacccaacgggatacgtccatgaaattatcccagaatacatggaaggcttgttgggggccgaattttacttgtgcggacctccacagatgattaactccgttcagaaattgctgatgattgaaaacaaggttcctttcgaagcaattcattttgatagattcttctagagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgag

SEQ ID NO: 31 - DNA, 10966 bp, Artificial Sequence
  Synthetic plasmid.
ctcgagggtgttttcacgagcaattgaccaacaaggacgtttaaacataaaggaggaatataatggcaattagtgcggcgacgaaagcggctactgatgcacttgcggccaaccgcgcgccaacttcagtgaatgctcaagaagtccaccgttggctccaatcgtttaactgggattttaaaaacaaccgtaccaaatacgccactaagtataaaatggcaaacgagacaaaagagcaattcaaattaatcgcgaaggagtacgcacgtatggaaagcgtgaaagacgagcgtcagttcggaagccttcaagatgcgttaacccgcctgcagagcgctgtgcgtgtgcatccgaaatggaatgaaactatgaaagtagtgtccaacttcctcgaagtgggtgagtataacgcaattgccgcaactggcatgctttgggactccgcgcaagcggctgaacaaaagaacggttatctcgcacaggttttggatgaaatccgccacacccatcaatgcgcgtatgttaattattatttcgcaaagaacggccaggacccggcagggcacaatgatgcgcgtcgtacacgcaccttggggccgctgtggaaaggtatgaaacgtgttttctcagatggcttcatctccggcgacgcggtcgaatgctcacttaatctgcaactggtgggcgaagcctgctttactaatccgctgatcgttgccgttaccgaatgggctgccgcgaacggtgatgaaatcaccccgaccgtgttcctgtcgatcgagacagatgaacttcgtcatatggcaaacgggtatcagaccgttgtttctattgcaaatgatccggccagcgctaaatatatgaatactgacttaaacaatgcattctggacacagcagaaatattttacgccggtccttggcatgctgttcgaatacggttcaaagtttaaggttgaaccgtgggtgaaaacctggaatcgttgggtctatgaggattggggcggaatttggatcggacgcctgggcaaatatggcgtcgaaagtcctcgctccctgaaggatgccaaacaggatgcgtactgggcgcaccacgacctgtaccttctggcatatgctctgtggccgaccggtttcttccgcttagcgttgcctgatcaagaagagatggaatggtacgaagcgaattacccaggttggtacgaccattacggtaaaatctatgaagaatggcgtgcacgcggttgcgaagatccaagcagtggtttcattccgctgcaatggtttattgaaaacaaccaccccatttatatcgatcgcacgtcacaggtccccttttgtccgagtcttgcgaaacacgcgacgaccttgcgtgtgcacgaatataacggtcagctccacacgcatgcggaccaatggggtgaacgcatgtggctggcggaaccggaacgctatgagtgtcaaaatatgtttgaacagtatgagggccgtgaattaagcgaggttatcgcagaactgtggggtgtgcgttcagacggcaaaacacttatcgcgcaaccgcacgtccgcggtgataaactctggaccctggatgatattaaacgtgttggatgcgttttttcaaaccctgcgaaagccctgaaagcgtaaatataggaggataataatgccgctgctggacgaaaaacgtcgtggcttgaccgacccggaatgggcgagcgttatcctgaacgccctgccggcagagcctttggataaacaaaacaagatgggctactttgttaccccacgctggaagcgtttgacggaatatgaagctctcaccgtttatgctcagcctaacgcggattggattgcgggtggtttggattggggagactggactcagaaatttcacggcggccgtccgtcgtggggcaacgaaaccacggaactgcgcacggtagattggtttaaacaccgtgatccactccgccgctggcatgccccgtatgtgaaagataaagcggaagagtggcgttacactgatcgctttctgcaaggctatagcgcggacggtcagattcgtaccatggaccctttctggcgcgatgaattcattaacaaatactggggtgcgttcctgtttaacgaatacggtcagttcaacgcccattcaggaggcgcacgtgaagcgctgtcggacaccatccgtgtatcgctgacgttttggggttttgataaaatcgatctggcccagatgatccagctggaacgtggcttcttagctaaaattgtaccgggctttgatgaatctacggcggtgccgaaagcagaatggacccagggctctgtctataaaagtgctcgtggcacgatcgaggcattgtggcaagacgtcttcgactggaacgaaaacgcgttttcagtacatgcagtgtacgatagcctgtttggtcaatttgtgcgtcgcgagttctttcagcgcttagcccctaaatttggcgataatctcacacccttttttatcaaccagagccagacctattacggcattgctaaacagggcgtgcaggatctctattacacctgtttagcgaatgatcctgaattcggtgactacaaccgcacagtcctccgcaattggaccgctaaatggctggaagggacggtgaatgcgctgcgtgatttcatgggtatttttgcgaagctgccgaccggaaccacacacaaggccgaaatccaggccagcttagaacgcgtgatcgacgattggaccgcggatcatgccagccgtattgatttcaaagtcgatcgtgatgcgattgttcgtcatgtcatgagcggtctgatttgaaataaggaggatattaatggcaaaaaacggtgtccatgacaacgccacacgcgatgcatgggttgtaaaaattgggcagttgaataccctggacaaagccgcggctgccttaaaacagtttcgtctcgatcataccactccgtttcgcaaaacttatgaactggataatgattatctgtggatcgaggctaaactggaggaaaaggttgctgtcctgaaggcccgcgctttcaacgatgaagacttccgccataaaaccgcttttggggaatgcgctaaaacgctcttagccgaagcggtcgcgaaaatggctgctacgggcgataaatgggaagcagaacgcattcatattggcttccgtcaagctaataaaccgcccattatgccggtgaactatttccttgaagccgaacgtgtccttggtacgaagctgatggaattgcgtaacctcaactactatgatacaccactggaagaactgcgcaaacagcgcggtgtgaaagtcttagtagcgccgcactaaatttaggaggaatattatgtctgtgtccagcaatgcgtattatgcaggtacgacgggtctgtcgggcaaggagttcgctgaagcattcttcgcggatgaaaatcaggttgtgcatgaaagcgataccgtcgttttggtgctgaaaaaaagcgacgaaatcaacacatttatcgaagagatcctgctggaagattataaaaaacatgtgaacccaaccgtcaatgttgaagaccgcgccgggtattggtggatcaaagctaacggtaagattgaagtggactgcgatgaactgtccgagcttctgggtcgttccttcaacgtctacgacttcctggtggatgtgagcagcactatcggccgtgcatataccctgggtaataaattcacaattacctctgaattgatgggtttagaccgtaagttggaagattatcatgcataattataggaggtattatatggccgcaacccactcaattaaagtgattactgaagatggcgaagccgtgtactttgattgccgtcctgatgaagatgtcatcagtgctgccatccgccaggatatctatctgatgtcctcatgccgcgctggtggctgcgcaacctgtaaagcgttttgcccggaaggcgactaccgcttagtgggttgttcggtgcaagcactgccgcctgaagaggaagaagacggccaggttctgctgtgtcgctgttatccggactcggatctggagctggaagttccgtatacctactcacgtattgcatttgaaccggaagctaatgagttcccggccgaggtagtgagcgttggtaaagtcagctcgaatgcagttcgtctgcatttgcgccgcccgggtatgggcaacgaacgcaaagtccgttttgatgcaggtcagttcatggaactgcaagtacctggttcggcagtcacgcgcgcgtattccccggccaacatctctaacgacgccggcgacctggagtttcttattcgtttattacctgatggccttatgtctaatgctctccgtggcggtgccattcagccgggtcagacgttgcaggtcaaaggtccgcagggaatcttcggccttaaagaaaatggctttcgtccgcgctactttattgcgggtggcacgggcctcgcccctgtactgagtatggttcgccatatgcgtgagtggggtgcgccccagcagactcgcctgtacttcggcgtcaataccgaggaagaagtctttctgcgcgccgaactggaagccctggctgccgctatgccgaatttaaccgtgaaagtctgcgtgtggcgccctaccgatggttgggatggtgaacgtggcaacgcaatcgaggtactccgccgcgacctggaggcgcagccggcgcagcccgatgtctatctttgtgggccgccgggtatggtcgatgccgcgtatgccgtctgtgcagagtttggtatcccagcggaccaaatctatctggagaaattcttaccgtcgggaccgtgtggcgaggcctgtgacccgggtcaagtgcacggtcatcaccagcacgccacagcctaattataggaggattaaaatgacaattgatttcgatcatttggatccggatgccctggatttcttatcggctcgctcgttaagccaagttccagcaggtacccctcgcaccgaactatttcagcaaggtcgctacgcagcgtacgcacaggacctgggtttcgcatggcgctgggccattgcccgcgacgggcgcgatattcaagaaggcccggcgctgtcgctggaatctgcccacctgagcgcacgccgtgtactggcattctttgttcgcttagactcgccgccgacaccggcctaataagtttaaacggatacgccctcgaatcctgggatagcggccgctcagtgaccggcatagcgtacgcctcgagttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggat

SEQ ID NO: 32 - DNA, 10954 bp, Artificial Sequence
  Synthetic plasmid.
ctcgagggtgttttcacgagcaattgaccaacaaggacgtttaaacataaaggaggaatataatggccatcagcactgccaccaaagccgccactgacgctctgggcgttaatcgtgctccgacctctgtcaatccgcaggaagtccaccgctggttacagtcgttcaattgggactttgcgcagaaccgcaccaaatacccgacgaaataccatatggcaaacgataccaaagagcagtttaaactgattgcgaaagagtatgctcgtatggaaagtgtgaaagatgaacgccagtttgggactctgcttgatggtctgacccgcctggaagctggcaatcgcgtccatccgcgttggggcgaaacgatgaaagtagcaagtaattttctcgaagtcggtgaatacaatgcaatcgctgcaaccggtatgctctgggattcagcaacggccgccgaacaaaagaacggttacctggcgcaagtacttgacgagatccgtcacacacatcagtgtggtttcatcaattattattttgccaagcattatcatgatccggcaggtcataatgatgcgcgccgcacccgtgcgatcggtcctctgtggaaaggtatgaaacgcgtctttgcggatggcttcattagcggcgacgctgttgaatgctcggttaacttacaattggtcggtgaagcctgcttcaccaatccgctcatcgttgcgatcacggaatgggcgtcggcaaacggcgatgaaatcactcccaccgtgtttctgtccatcgagactgatgaacttcgccatatggccaacgggtaccagaccgttgtatccattgcgaacgacccagcggcgcaaaaatatctgaacacggacctgaacaatgccttctggacgcaacagaaatacttcaccccggtcctggggatgctctttgaatacgggagtaaattcaaagtggagccatgggtgaaaacgtggaatcgctgggtctatgaagattggggaggtatctggattggacgcttggccaagtatggagtgaacagccccccgtctctgcgtgatgccaaaaaagatgcgtattgggcacatcacgatctgtttctcctggcgtatgcattgtggcctaccggtttcttccgcctgtccctgcctgacgaagaagacatggaatggtttgaggccaactatcccggttgggatgaacactatggtaaaatccttcgcgaatggaaagcgctcggctgcgaagacccgaaatctggttttttacccatccagtggctgatcgaacacggacacaaagtgtatatcgatcgccccagtcaagttccgttttgcccaacattggcgaaatgcagcgggtcccttcgtgttcatgagttcaatggtcagaagcatgcgtttgcggatgattggggcgagcgtcaatggctggcggagccagaacgttatgaatgtcagaatatttttgaacagtatggtggccgcgaactgtctgatgtggttgttgaaggccatggtgtacgcgctgatggcaagaccttaattggtcaaccccatgtgcacggcgaccagctgtggacggtagaagatttgaaacgtgcgaattgtgtgttcgctgatccgctggcggatttatgaatataggaggataataatggcgatcgcgacggccactaccactaaacgcggactgactgacccggagcgcgcggctaaaattcttgctgccattccggatcacgaattagacacccaacgtcgtatgaactacttcgttgaacctcgctggaaacgcctttcggaatatgagattctgacttcctatacccagcccaatccggattggatcgctggtgggctggactggggcgattggacgcagaaattccatggaggtcgcccttcctgggggaacgagagtactgaactgcgtaccacagactggttccgtcaccgcgatccggctcgccgttggcatgctccgtatgtgaaagacaaagcggaagaatggcgttatacaacgcgctttctggagggctatagtgcggaaggagccgttcgctcaatcgatccaaagtggcgtgacgagatcctggcaaaatattggggtgcgctgctgtttagtgagtacggtcagtttaacgcccacagttctgtggcccgcgatgcgctgagtgacaccattcgctctaccgcgacctttgcggcgctcgataaggtggattgcgcccagatgattcagcttgaacgcaactttcttgcgaaagtggtgccaggttttccggagagcacagaaggcccgaaaaacatttggctctctgatcccatctataaatctgcgcgcacgacggtggaagaattctggcaaggtattcaggatttttccgagattttatgggccgtgcacggggtttatgatccgctgttcggtcaatttgcacgccgcgaattctttggtcgtatggccgcgcattatggcgattcgctcaccccgttctttctttcgcaaacacagacgtactttcagaccacgaaagcagccatgagcgatctgtttttttatagcctgggtgatgatcccgaatttggcgatcataatcgcacttggttccgcgcctggacggaaaaatggcttaaaatgactgcggatagcctgcatgattttctgggcatttatgccaaagtggagaaggtccccgggctgagtgataaagcaggaattatcgcggcagtctcacgcgtagttaatgactgggtggaagactatgctaaaaaaattgattttaaagtggatgcagatcagcttgtggcaagcatcacacgcgatgttaaataaaataaggaggatattaatgcccaactataagatccatgacaaccctgtacgctccgaatggcaggaaaaaatcggtgagctcaaatcagtcaaagatgctacggcattcattcaggatttccgtaaaaagtacaccagtcccttccgtacgtcctacgcattagatgtggattatctgttcatcgaagcgaagatcgaagaacgtctggcggttcttaaaacctcaacctactcggcaacagatctcttctcgatggcgacaactggggaagccgcacagaaagtagccgatacgtggattgctaagatggatgcggagaaagataaatttgccgcagaaaaaatcctcattaccttccgccagctgtacaaaccgccggtgctcccggtaaatgtctttttcaaagttgatactcatttaggtagccgtctgatggaattgcgtaacgcggactactacgctgatagtctggaagaattgcgtaaaaaacgcggtgtgaaagtgctgaagctggggaatgcggcctaaatttaggaggaatattatgaccgcccgtaatgcatataacgcgggcatcatgaaaaaaaacggcgaagcattcgcaaaggagttctttgcggaggagaaccaagtggtccacgaatccaacaccgtggttctggttctgatgaagagcgatgaaattgatgctattgtggaagacattatcttaggcgaggaagccaaacgcaatccgactctggtggtggaagatcgtgctggcttttggtggatcaaggccgatgggaaaattgaggtcgataccgagaaggccgcggatctgttgggtaaaacctatagcatttatgatttcctggtaaatgtgagttccacaatcggccgcgcgtacactctgggcaacacatttacgattacaagcgagctgatgggcctggatcgcaaactcacggacatctaattataggaggtattatatgtacaaagtatctgttatcacagaggatgacttcgaggtgacgtttgagtgccctccgaatgagaatgtgatttctgccggggtgaaatctgacgtgattctgctcagctcttgccatgaaggtggctgtgcgacgtgtaaagcggaatgcctggagggcgattatgaactgggccgttgtagcgttcaggctttacctccggatgaagaggaagcggcagtagtacttctgtgtcagacttacccccgttcggatctggtttttaaagtgccctacaccttcgaacgcatctcgttccagaaagttaataccgattggaaaggtgaaattgttgccgtggagaaaattgcaagcaatgttgcaaagctgcaaattgtacctaaagatccggagaacggtcaagcggttactattccatttgtgccgggccaatatctggacatcgaaatcccggggactcaagcgagccgttgctattccatggccaccatcgatgatgatccacgcctggatttcttaattcgtatcctgcccggtggtcgcttttcccagtttttatcgtcggaagccgaaccgggaattgtcatgcgcttacgtggtccctttggtggattcaatatccgcgagaatggattgcgtgcacgttattttgtcgcgggaggcacgggactggcgccagtgctgagtatgatccgttacatgaaacgcgagcaacatcctcaggaggcgaaactgttcttcggcgtgacccaccagcacgaacttttctatttggatgaactcgaaaagctggaagctgaaatgcccaacttaaaagtttatgtgaccgtaattaaggccgacgcggcttggcagggtggaacgggcaccgtggttgacgaactgaccaaacagttgcaggatgcgaaagcgaaaccggatatttatctgtgcggcccgccgccgatgatcgacgccgcgttcgcagcagcggcgatttatggtgtgccgccggaacagatgtatgtggaaaaatttcttgccagtggacaagctgcggcagccgaataattataggaggattaaaatgaaacgcctcatgattgaagaagacccggacggaccggcgtcggtgagcagctttcagggcaacgcaggtagcgcggccattgcaggctttgcagaggcggctattgcgccggtagaaatcttcaatgatggccgttattcggcttttgttcaggaccttgagtgtgtatggcgttgggaaattcatcgcgatggccaatttgtgcaagaaggctgtagcctgtcggaacgttcttcgcgtgaagctgtgggatatgtgatgtctttttatcgtcgccgcgatgagcgtcaggccgcagaacctgcaatctgcgaatgataagtttaaacggatacgccctcgaatcctgggatagcggccgctcagtgaccggcatagcgtacgcctcgagttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggat

SEQ ID NO: 33 - DNA, 10936 bp, Artificial Sequence
  Synthetic plasmid.
gaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggatctcgagggtgttttcacgagcaattgaccaacaaggacgtttaaacataaaggaggaatataatggccgcgagcaatcttgcagtgaaacaggcgttgaaaaacaaccctgcgccgtcgtcggttgacccgcaggaagttcataaatggttacaggacttcacttgggatttcaaagaaaaagcaggcaaatatcccacgaagtatgacatggatgtgaatacccgtgagcaatttaagttgacggcgaaggaatatgcgcgcatggagtcagccaaagaagaacgccaatttggtacccttcttgacggcctggatcgcctcgatgccggcaacaaggtgcatccgcgttggggcgaatttatgaaattagttgcaaacttcctggaaaccggtgaatatggtgcgctcgcaggttcggcacttttgtgggatactgcacaaagcccggaacaacgcaatggttacttagcgcaagtgatcgatgaggtgcgccacgtgaatcagtgcgcatcggttagttactattattcaaaacactattacgatcccgctggtttcacaaatatgcgccagttacgtgctattaaccctctgtatccaggtgtgaagcgtgctttcggtgaaggttttctggcgggcgatgccgtcgagtccagcattaatttacagctggtagcggaggcgtgctttaccaaccccctgatcgtagctttaaccgaatgggcggcggcaaatggggatgagatcactccaaccgtgttcttgagcattgaaaccgatgaattgcgccacatggcgaacggctatcagacgattgtgtctatcatgaataaccccgataccatgaaatatctgcaaactgatctggataacgccttctggacgcaacacaagttcctgacgccattcgtaggggcggcgttagaatatggttcgcgttttaaagtcgagccgtgggcgaaatcgtggaaccgctgggtttacgaggattgggcaggcatttggttaggccgcctgcaacaattcgggttaaaatccccaaaatgtctggccgacgcgaagaaagatgcagtctgggcacatcacgatctggccctcctggcgtttgcgttatggccgttaacaggtatccgcctcgaattgcctgaccgtcaggatatggaatggtttgaagcgaattatccgggctggtatgaacactatggaaaaatttacgaagaatggcgtgcccttgggttcgaagatccccgttccggatttagtggtgctgtgtggatgctgcagcgtggccatggcatttttattgaccatacgtcaagcctgcccttctgtccgacgttgggtaagggtgctctgaaaccttcgtttctggagaagaacgggaaacgttttgcattcagtgaaccgcacggtgaacgcatgtggttgcaggagccggagcgctacgaattccaaaacttcttcgagcagtttgaaggctgggaattgagtgacctcgtaaaagcggctggtggtgtgcgttcggacggcaaaactttgatggcgcagcctcatctgcgttccactgatatgtggactctggatgacctgaagcgtattaattttaccgtgccggatccgatgcgcattctgaactggcaaccggcccattgaatataggaggataataatgtcctcgaactcgtttgtacgtggtatggtagatccttatcgtcagaccatcattcaggcagcaattccggaacagccgttagaaagcaaacgcgatcatattccttttgcgaagcgcggttggcgccgtctcactgaatatgaggcggtgatgctccacgcacagaatagcgtagactccgtgccgggctcacaggaggtgggtgagtctgtacagaaatggccgggcggtcgcccgaattactctattgagtctactgctgttattgcaggtaattggttttactttcgcgacccagcgaaacgctggttcatgccgtatgttaagcagaaaacggaagaaggtcaaaccgctgagcgtaccatgaaaagctgggcagagtccggagatgccggaatgatgaacgccgattggcgtaatcaaatcctgggtacccactatggcgccttggtgtataatgaatatggcctcttctccgcacattcgacgacagtttatagtgctctgtccgacttgctgaagacctggatctcggaagcagggttcgataaaaatgatgccggccaaatgattcagatggaacgtattctgctcggcaaattgtttgctgatttcgacccgagtctggccgctgctaaacaggcctggatgcaagacccgatttggcaaccggcgcgtgaattcgttcagcatatctggatgggtgtctatgattgggttgaacagctgtgggccatccatggcatttacgatcacattttcgggcaattcgtgcgccgtgaattcttccagcgcctggcgggcctgcacggtgatacgcttactccctttatccaatcccaggctctgacgtaccatcaacaggccagcgacgcgctgcaagccttttgtgtaaaaatgttgatcgacgaagagccggtatacggggctcacaatcgccgctacctgcgcgcatggaccaagcgttatctccctggcacccaggcggcgctgaaagcgttcctggctatctacaaaaccctgccgctgcaagtggaaggaattacctgcaaagcaagtgtagaagcagcagtgcgtcgcattgtgaacgattgggcccgccgttttgccgaaccgatcgattatcgctttgatgcagaagcattcattgccgacgtcatgcaggggtactaaaataaggaggatattaatgagcaagcagcattggtatcacacgccaacgcgtgatgagtggctggaacgcattggtaccctgcgcaccgcccgtgaaggaattgaaatgttgcgcaactttcgtgagcagcatctgggtccagaccgcaagacttatgatctgaagaaagaagcaaattggattgagtcgcgtattgaaatgcgtgtgtcccagctgcacgccgaggaaactctgagtgatgacgatctcctgcacaaaacgattgatggccgctgcgcccgtgaggttgccaatagttggtgggaaaaagcagcacaagttgattccgcaatcgaactgggccagctctgcgtggcctaccgtaaggcgtgtaaaccaccgatgatgcctattaattactttgcgccagtcgagaaaaaattggttagtaaactgctgaaattgcgcgcggaaaattacctggtgacgcctatcgaagaactgcgtaaagcccgtaatgttacacctatccatgtgcagtgaatttaggaggaatattatgtctactaacatcaacggttataattcgggtaccaataacaagacgggacaagcatttgtcgacgaatttctgagcgaaaaaaactgcaccctgcctacgtccgacgcggtagtgcttgccctgatgaagacagaagaaatcaatgttatcgtcgatgaaatgattcgtccaatgatggatgacaacccggccctggccgtcgacgatcgtggtgggtactggtggattaaagtgaacgggaaaatcgtcatcgactgtgatgaagcaactgagattttgggcaaaaaatataccgtgtacgattttctggttaatgtgagcaccacaattggtcgtgctatgaccctggggaaccaattcgtactgaccaatgaactgttgggtctggaaactaaaatcgattcagtgtactaattataggaggtattatatggattcgcgttacaccatcacggctaactttgaagacggcgccctccatcagttcgaatgcgcggaaaacgaagatatcctgtcagcggcgcttcgtcagcaggttgtgctgctgtgctcttgccgcaaagcgttctgcggatcttgtaaagcgctgtgtatggaaggtgaatacgcctttggggatcgtgtaaatgtacaggtgctgtcgccgaaagaagaagaggatggtgtcgtggtggcgtgtgacacttttccccgtagcgatatggcactggcattcccatataccagtgaccgcctgggatcatgttcttccgaaaatctcgaagctcaggtggagatcgttgagcgcctgtctagcactgtgtacaagctgctgctgcaggttcgtgatccggtgagtcatgaagctaagcgtatcgagttccaaccgggtcaatacgccgaattgcagctgccggatggtgagcaaacacgtgcgttttcgtttgcaaatatcgcggacgattctggcttgctcgaatttctgatccgcttggttccgggtggatgttttagtacctatctgcagcagcgtgcagttccgggcgacgtgctgaagctgcgcgcgccgcttggtgccttcacgttccaaccgggggaccaagacgaaggcctgcacgcgtttgtgggaggttcgaccggattggcccctttgctgtctatgctgcgtggtttagcccgccaagattatcgcggcgaatgtcatctgttttttggtatgcaggaccaagccgcgctgtactacgaagacgagctgcgcgaattagcggcaagtatgccacgcttaaccttgcatctcgctctcatggatcctccgccacaatggcagggctacacggggaatgccgtgaccgcgtttgaacaacactttgccgctttagcgcgcaagccggaagtctatatctgcggtccggctgcaatggttgaggccactcgcgcatcttgtgaacgtctgaatatcccggagcaccgcgtgcaccgtgaggaatttgtcgccagcggaggttaattataggaggattaaagtgaacacgcgcagcggcgatacgccggctattccccgtcttgacggcctgccccaggcagtgggcgccacggtgctgattcatgaagacggtgaatttcgtgtgtatgcgacggaacttgaaatgctgctgcgctgggatctgttccagggcgatcgccatctgcacaccggttcagctctccgcgttgaaagctgtatcgtttcagccaagggcaaaattggcttttttcgccgtcctactgttgcacgtctgatcgccgcaggcgacgaggcaagccccaacgatccgagctaataagtttaaacggatacgccctcgaatcctgggatagcggccgctcagtgaccggcatagcgtacgcctcgagttacgcccgttctgcttgacctggtaaagttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggc

SEQ ID NO: 34 - DNA, 13204 bp, Artificial Sequence
  Synthetic plasmid.
ccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatctcgagggagagcaggacctccgctgtgactcttcttttttttcttttattctcactacatacattttagttattcgccaacatggccatctctttagctaccaaagctgctaccgatgctttaaaagtaaaccgtgcccctgtcggtgttgaacctcaggaagtgcataaatggttgcaatccttcaactgggacttcaaggaaaaccgtacaaagtacgcaactaagtaccatatggcaaatcaaacaaaggaacaatttaaagtaattgcaaaagaatatgccagaatggaagccgctaaggatgaacgacaattcggcactttattagacggcttgactagattaggtgctggtaacaaggttcatcccagatggggtgagactatgaaggttatttctaacttcctggaagtaggtgaatacaatgctatcgctgcttcagctatgctgtgggattccgctacggccgcagaacagaagaacggttatttagcacaagtgctagatgagatccgtcatactcaccaatgcgcttttataaatcattattattctaaacactaccatgacccagctggccataacgatgcccgtcgtacacgagcaattggcccactatggaagggaatgaaaagagtttttgctgacggtttcatttcaggtgatgccgttgagtgcagtgttaacctacagctagtcggtgaggcttgtttcaccaatcctctaattgttgccgttactgagtgggcatcagccaatggggacgagataacaccaactgtttttttgtcagttgagacagacgaattgagacacatggccaatggatatcagacggttgttagtatagcaaatgacccagccgctgctaaataccttaacacagacttgaacaatgccttttggactcagcaaaaatactttacccctgctttgggctatttgtttgagtatggttctaagtttaaggtcgaaccctgggttaaaacatggaataggtgggtgtacgaggattggggtggtatttggattggtagactgggtaaatacggcgttgagtctcctaggtccttgcgtgatgccaagactgacgcctactgggctcatcacgacttagctcttgctgcctacgctctgtggccattaggatttgccagacttgcattgccagacgaggaggaccaagaatggttcgaggctaattatccagggtgggccgatcattacggaaagatttacaatgaatggaaaaaattaggctacgaggatcctaaatccggttttattccatacgcatggttgttgcaaaatggtcatgatgtctatatcgacagagtgtctcaagttccctttattccctccttagcaaaaggttcaggctcccttagggttcatgagtataacggaaagaagcattccttgacagatgattggggtgaaaggatgtggttgtctgagcctgaaaggtacgagtgtcactccattttcgagcaatacgagggaagagaactttctgaggttattgctgagggacacggggttaggtccgatggtaagactctgatcgctcagccacatgttagaggcgataatctttggactcttgaggacatcaagcgtgcaggttgtgtgttcccagaccctttggccaagttctaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatgtctcagccacagtcttctcaggttaccaagaggggactgacggaccccgaaagggcagctatcatcgccgcagctattccagatcatgctttggatacccagcgtaaataccactatttcattcagcctagatggaagaggttaagtgaatatgagcagttgtcctgttacgcccaaccaaacccagattggattgctggtggtttggactggggtgactggactcagaagtttcatggtggtagaccctcttggggaaacgaatctactgaacttaggaccaccgattggtaccgacacagagatccagcacgtaggtggcacgcaccttacgtcaaagataagtctgaggaagctagatatacacagagattcttggcagcatactcatctgaaggttccattcgaaccgtcgacgcatattggagggacgaaattcttaacaaatattacggtgcattgttatataacgaatacggtttattcaatgctcactcttctgtgggcagggactctctgtctgatacaattaggcaatccgctatatttgctgctcttgataaggttgataacgcacaaatgattcaaatggaaagattatttattgcaaaattggtgccaggtttcgatgcttctacggatgtgcctaaaaagatctggacaacagatccaatttatgctggcgctagaggtgcagtcgaagagatttggcagggtattcaagattggaatgagatattgtgggccggtcacgccgtctacgatgctaccttcgggcaattcgctagaagggaattttttcaaagacttgctactgtatacggtgatacattgacccctttctttacagcccaatcacaaacttatttccaaattactagaggtgcaattgaggacctgtttgtctactcccttgctaacgaccccgaatttggagcccataacaggacttttctgaatgcatggactgaacattatcttgcaagatctgtgacagcattgaaggattttgttgggatctatgctaaggtggagaaagtggctggtgccactgacagagctggagtctctgaagcactacagagagtatttggggactggaaagtggattacgccgacaagatcggtttcaagattgacgtagaccagaaggtcgacgcagtactggcaggttacaaaaattaaattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatggcaaagagggaacctattcacgaaaattccactcgtactgagtgggagggaaagatagctaaactgaactctgttgatcaggctactaagtttatccaagattttcgagttgctaattcctctccttttaggaagtcatatgatctagacgtggactaccaatatatcgagagaaagattgaagagagactgtccgtattaaagaccgaaaagttatcagttgccgatttagtcaccaaggccacgactggtgaagacgccgctgctgttgaagctacatggattgcaaagatgaaggcagccgagtctaaatatgcagccgaacgaattcatgttgaattcagacaattgtataagcctcctgttctaccagtgaatgttttcctgagaactgatgcagcattaggaactatcttaatggaacttagaaataccgactattatgctactcctttagaaggattgagaaaggagcgtggggttaaagttctacatcttcaggcataggcgtgcttcttttttgtttctttagttgtttagtttttggcactggttttggtcgaccttttgttttaagtagcctatatatgcagttaaatgattgatagtttgatttattccgtgcaacttaagggattgtgattgggcgtggcaatctacctacattctatttacctgcaatcttaggattgagattgattcagattctcttgaaggggaagggttagactatttaaaattcatacatacagttcattcttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatgtatcagatcgtgattgaaactgaagatggagaaacttgttccttcgagtgtgggccttctgaagatgtgatatccgctggacttaggcagtccgtcatcctgttaagttcctgccgagctgggggatgcgccacgtgcaaggccgattgtacggacggtgattatgagttgatcgacgtaaaggtacaggcactacctcctgatgaggaggaagatggtaaggtgttactttgcagaacctttcctcgatcagatttgcatttaatcgttccatacacttacgacaggatttcattcgaggcaatccagactaactggctggccgaaattgttgaatgcgatagagtatcttctaatgtagtcagacttgttctacagccactgaccgctgatggcgcagctccaatcgccttaaacttcgctcctggtcagtttgtcgatattgagatccccggtactcacaccagaagatcctacagtatggcatccgttgcagaggatgggcgtcttgaattctttattcgtcttttaccagatggagctttttctaagttcttgcaaacccaagctaaagtgggattaagagtcgccctacgtggacctgctggttcatttatgctgcataaatctgaaagaccacgtttcttcgttgctggaggcactggcttgtctcctgttttaagtatgataagacagttgaaaaaagaatccgatcagcaacccgctaccttgttctttggtgtaactaattatgaggagctgttttatgtcgaagaactgaaagctctacaaaacgctatgccctcccttgatgtgcaagtcgccgtcgttaatgcatctgaggctaatggtgttgccaagggaactgtgatagatcttatgagggccgaactggagaaacttagaggtaagccagacatttatttatgtggtcctcctgggatgattgaagcagcatttgatgctgctgccacagctggtgttcccaaagagcaagtctacctggagaaattcttggcttcaggctagagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgag

SEQ ID NO: 35 - DNA, 13225 bp, Artificial Sequence
  Synthetic plasmid.
ctcgagggagagcaggacctccgctgtgactcttcttttttttcttttattctcactacatacattttagttattcgccaacatggctgcttccaatttggctgttaagcaagctttaaagaacaacccagctccatcatctgtcgatccacaagaggttcacaagtggttgcaagattttacctgggactttaaggagaaggccggtaagtatcctaccaagtacgacatggacgtcaatactcgtgaacagttcaagttaactgctaaggaatacgcaagaatggagtccgctaaagaagagagacagttcggaaccctgctagatggattagaccgtttggatgctggtaacaaagtgcatccaagatggggagaatttatgaaattagtcgcaaactttcttgagactggggaatatggggcattagccggtagtgctttgctttgggatacagctcagtcccccgaacaacgaaacggttaccttgcccaagtgatcgacgaagttagacacgtgaaccaatgcgcatctgtatcatattattactccaagcattattatgatcctgctggattcacgaatatgagacaacttcgagctattaaccctttgtatccaggagttaaacgtgcattcggcgagggttttttggctggcgacgctgttgagtcttccatcaatttgcagttggtggctgaggcttgtttcacaaatccattaattgttgctctaaccgaatgggccgcagctaacggggacgaaatcacacccaccgtatttctgtctattgagacagacgaattgagacatatggctaatggatatcagaccattgttagtatcatgaacaaccctgatacaatgaagtatctgcaaactgacctggataatgctttttggacgcaacacaagtttttaactcccttcgtaggtgctgccttggaatatggatctagattcaaagtggagccatgggcaaaaagttggaataggtgggtctacgaggattgggctggtatctggcttggccgtcttcagcaattcggtcttaaatctcctaaatgtttggccgatgcaaagaaggacgccgtttgggctcatcatgatcttgctttactggctttcgctctttggcctctgactggtattcgtttagagttaccagatagacaagatatggaatggttcgaagctaattaccctggatggtatgaacactatggtaagatctacgaagagtggcgtgctttaggttttgaagatccacgttccggtttcagtggtgccgtctggatgttgcaaagagggcatggaatttttattgaccacacatctagtctgccattctgccccacactgggcaagggtgccttgaaaccatcatttttggagaagaatggtaagagatttgctttttccgaaccacatggtgaaagaatgtggctgcaagaaccagaacgttacgagtttcaaaactttttcgaacaatttgaaggttgggagttgtccgatcttgttaaagcagctggtggcgtcagatctgatggtaagacacttatggcacagccacatttgagaagtaccgatatgtggacattagacgatttgaagaggataaacttcacggtaccagatcctatgaggattctaaattggcaaccagctcattaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatgtcctccaactccttcgttcgaggaatggtagatccctacagacaaactatcattcaggccgctattccagaacaaccattggaatctaagcgtgaccacattccatttgctaagagaggatggcgaagattaaccgagtacgaagcagtaatgttacatgctcaaaactccgtcgattcagtgccaggctcacaggaagttggtgagtcagtccaaaaatggcctggcggtcgtcccaattactctatagagtctacagctgttatagcaggaaactggttctatttcagggaccctgcaaagagatggttcatgccctatgtaaaacagaagactgaggaaggtcagaccgcagaaagaactatgaagtcctgggctgagagtggagatgcaggtatgatgaatgctgactggcgaaatcaaattttgggaacccactatggtgcactggtttataacgaatacggacttttttctgcccactctactactgtttacagtgccttgtccgatttgctaaagacatggatctctgaggctggtttcgataagaatgatgcaggacaaatgattcagatggaaagaatcttgttaggcaagctgtttgccgactttgatccatcattggctgctgccaaacaagcttggatgcaagatccaatctggcaaccagccagagaattcgtccaacatatttggatgggtgtttatgactgggtggagcaactttgggctatacacggtatttatgatcatatcttcgggcaattcgttagacgtgaattttttcaacgtcttgctggtttacatggcgacactttgactcctttcatccagtcacaagctcttacttaccatcagcaagctagtgatgcacttcaagctttctgtgtgaaaatgcttatcgatgaagagcctgtgtacggagcccataatcgtagatacctgagagcctggactaagaggtatttgcctggaactcaggccgccttaaaagcttttttggcaatatataagactttgcctcttcaggttgagggcatcacatgtaaagcttccgttgaagccgcagtgagacgtattgttaacgattgggcaagaagattcgccgaaccaattgactataggttcgacgcagaggcatttatcgcagacgttatgcagggttattgaattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatgtccaagcaacactggtaccatacgccaaccagagatgaatggctagagcgtattggtaccttgcgtaccgctcgtgagggtattgagatgctgaggaactttcgtgagcaacatttaggtccagatcgtaaaacttatgatttgaaaaaggaagctaattggattgagagtagaatcgaaatgagagtcagtcagctgcatgctgaagaaaccttgagtgatgacgatctgttacacaaaaccatcgatggacgatgtgctagagaagtcgccaattcctggtgggaaaaggctgcccaagtggattctgccattgaacttggccagttgtgtgtggcctacagaaaggcttgcaagcctcctatgatgcctataaactactttgctccagttgaaaagaagttagtctccaagttgttgaagctaagagccgaaaactaccttgtcacgcctattgaagaactaaggaaagccagaaatgtgactccaattcatgtccagtaagcgtgcttcttttttgtttctttagttgtttagtttttggcactggttttggtcgaccttttgttttaagtagcctatatatgcagttaaatgattgatagtttgatttattccgtgcaacttaagggattgtgattgggcgtggcaatctacctacattctatttacctgcaatcttaggattgagattgattcagattctcttgaaggggaagggttagactatttaaaattcatacatacagttcattcttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatggactctcgttacaccatcactgctaatttcgaagatggagctctgcatcagtttgagtgtgctgagaacgaggacatcctttccgctgctctaagacagcaagttgttcttctatgctcttgtcgtaaggcattttgtggatcctgtaaagccttgtgtatggaaggtgaatacgctttcggtgatagagtgaacgtccaagttctaagtcccaaggaagaagaggacggtgtcgtggtcgcatgtgacaccttcccaagatctgatatggccttggcattcccttatacttccgatagactgggttcatgttccagtgaaaatttggaagcacaggtagagatagttgaacgattgtcttcaactgtatacaaactgctgttgcaagtccgtgatcctgtttctcatgaagctaaaagaatagagtttcaaccaggacaatacgcagagttgcaattgccagacggcgaacagactagagctttttcttttgccaacattgctgatgacagtggcttattggagttcttgataaggttggtccccggaggttgtttctccacttatttgcaacagagggccgtgcctggggatgtcttaaagttaagagctcctttgggcgctttcacctttcagcctggcgatcaagatgaaggtctacacgcctttgtaggcggttctactggacttgctcctttattgtctatgttgcgtggtttggctagacaggactacaggggtgagtgtcatcttttttttggtatgcaggatcaagctgccttgtactacgaagatgagcttagggagctggctgcttctatgcctaggttaacattgcatctagccctgatggatcctcctccacaatggcaaggttacaccggtaacgctgtgaccgcattcgagcagcacttcgctgctctggcaagaaaaccagaagtctacatatgcggtccagcagctatggtcgaagccactagagcatcttgtgagaggctaaatataccagaacatagagtccatagagaagaattcgttgcttcaggtggttaaagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgagccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaat

SEQ ID NO: 36 - DNA, 11683 bp, Artificial Sequence
  Synthetic plasmid.
ttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttatgggtaccaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgcggccgctcttaagggtgatgtagccctcgccgtttttcgaatagctgtagatacattgacgggaacaaagagaaactctaagggatacactctatcattggtgaaaaagtttatttcaattgttgacggctttgaagttcttgacagagattaccttgtttcctcgattgtaactcacatgtcctcattggatcccaaatgttcggagtatattgttattgctttagcgcttccattgcgatatttgtctatttcgtcaccagagtttccaatcaagctgcagctgtctgtcaagaattatctaaagctagatgagccctcaactagaaatggctatgttgagtttttaaccaaacttttggaagcatgtagaaacgaagaaaatgatacaagagctgttttactacaacaattagtaaagaaatgcaaatgttctgtgtgatagcctttcttttttgaattcagcatgttggtttatggtgttttattgaagccatgactgagcctttttacttagatgaccacatgacttatgagacgtcaattaaggaggaccagtagaataagatcgcaatagtttctgctgtcatgatgaagcgtatatacagagccaaatcttcatgcatacaataacatattgtgtttcctcccaaataattaacaatgacttacctgtatatccaggacactcctgtactgagaccgaccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgatgtactgagaccgctctgtgctctagtattgataattggtctactactagatagatgcctaacattaatgatatagtcgtatcagtctttgctgtaaataaagcctccggaatgagatctaaagaatcagcccagatgtttggaaggagggaaagatacgcctttctactaattaagccagttttgatctcagttgattgatgtcctgtctctgcgatagctcaaaactggcaactgaaacagatagtatattaattttcagttgctaatgataagccattgtaacattcctatcacatcggccgtttgcctcttttttgggaaaactctttccagtgaatgcacagcttatcgctttcaatgcttcaaaggcaacttccctactaagacactaaatatatatacatcaatgaacatatagtgggaaaaatggtagtgaagaagtagtcatttgtttgaatataagttggctgtacatgtgcctccgtagtctgtggccgagcttcatccacctagcaattgaaactgaagagctaagctcttcatattctcattcggttctgttattctcttttacttcttcttgtcaaaatattatgtattatgtgtagtacccgaccaacatggagaattcaatctaagaaatagatgtcaccccaagccgaacaaaaacaaccggtgaagaaaacgtaactgagtgaatggaattgtgattcaagcaattagagtaattgaatttcacttctggtacgagaaataaagtgaaaaacaaaatacctccgcataattagtgacgaaaaaaaccacacgtatactattcactgagtgaaagtgcgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatctcgagggagagcaggacctccgctgtgactcttcttttttttcttttattctcactacatacattttagttattcgccaacatgtcctcagcccacaacaactataatgccggtattatgcagaaatcaggaaaagcattcgccgatgaattcttcgcagaggagaaccaagtggtacatgaatcaaatgctgtcgttttggtcctgatgaagtctgatgaaatcgacgccatcatcgaagacatcatattgaaagggggtaaagctaaaaacccatccatcgttgttgaggacaaggctggattctggtggatcaaagcagatggagctatcgaaatcgatgctgctgaagctgctgatttactgggcaagccattctctgtttacgatttgctgatcaacgtttctagtaccgttggtcgtgcttacaccttgggcacgaaattcactatcactagtgaattaatgggattggatagagccttgacagatatttaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatggctcaatgtgccgagcaagccgcagaggaacaaagaattttgatccacgcagattctagatatgctgcatataccatggacttggactatatgtggcgttgggagatcctgagagacggtgagtttgttcaagaaggatgcagtctgtctcttgactcagcaagggaagctgtttcacatgttctgagattttttcagaggcaagacgaggctgccgcccgtccaggagacaattccgcagagattaagagattgcttcaatctttgggaaccccaattcctatcgacgatagaaacgaaaccacaaagaatgagttggctcaacctgaatagattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatggcaagaaatattagatttggtgatcccgttagaaaaagacttctggatggagttgactttctagctgacgctgttggtgttaccttggggccatgtggaaggaatgttgtcatcgaacatagggcctccggcttaccacccgtagccaccaaggacggtgcaacggttgctcaggccgttgaagccgccggtcgtactgaaagtgttggtatcaatttagttagacaaatggccactaccgttgcaaaagaggctggtgatgggacgacaacctctgtcgttttgacacgaagggtggctgccgaaactcgtaaggcccttgcagctggaatgaatccccgtgacatcacattaggcatggagagggccgcaagagcagttgaagcagacttgttgagacgtgcaagacgttgcaacgaccagaggtcattggctcatgttgccaccctagccgctggtggagatgagggtatcggtgctattgttgcacaagctttggccttagccggtgagggaggagttgtggatgtagaactaggtcacggcgtcgccgatgacatcgagtctgttgagggcatgagatgggagcagggctaccgttccccatatttcatgacagactcagctaggaaggtagctgagctggaaaatccttatattctggtctatgatagagttatcaacgaattctctgagctggttcctgcacttgagttggtcagaagatctggcggatctcttctagttgtagctgaaaacataatggaggaagcccttccaggcttgttgttgaaccatattagaaaaaatttgtgctccattgctgtgaaggggccaggatatggtgattcaaggtatgaatatttattggatttagctgctataaccggaggtagggctatcatggaagcattcggtgaagacatttccaatgtaactatggagcacttgggtcgtgctagaagagtcgttgttagggaagatgatacgctagtcattggtggtgagggagatcctaacgtaatcgcagatagactagcaagtgctaaacgtcaggcagattggattgttgaaggagacgcatctaagggctccccttcaggaaaaagacatgagttagaaaacttgcagacacgaattaaggccctgagtggacgtatggcaacaattagggctgggggcctgtctgacgtgctgattaaggaaagaatgcaaaggatcgaaaatgctttaaactctgctagggccgcacaatctgatggagtcgttgctggaggtggagtgggtttgtatcgagcaagggctgccctggctgaattaaggggtgagaacctggaccagtctcacggcgttgccattgtgcgtgcagcactggatgaacctatcagaagaatcgcagccaacgctggggtggatgctgatgaattcttgttcgagctacgaagaagtaatgatgatttctggggcatggatatgagaagtggtgcttgtggtgatcttttcgctgcaggagttattgatccagttcgagtaaccagacttgccttaagaaatgcagttgccactgcagcctctcttatgaccgttgaatgtgccgtcacacatattcctgtttctgaccctactttcggatttgatgctagaagagccgctgaaacgagagaagatcctagagcctaagcgtgcttcttttttgtttctttagttgtttagtttttggcactggttttggtcgaccttttgttttaagtagcctatatatgcagttaaatgattgatagtttgatttattccgtgcaacttaagggattgtgattgggcgtggcaatctacctacattctatttacctgcaatcttaggattgagattgattcagattctcttgaaggggaagggttagactatttaaaattcatacatacagttcattcttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatggctttcagacccttgcatgatagagtggtcgttaaacgattggaaggagaagataaaaccaaaggtggaatcatcattccagatactgccaaggaaaagcctgctgagggtaagatcattgccgttgggcctggcgcaagagatgagtccggaaaattggtcgcactggatgtcaaagaaggtgatcgagttttgttcggtaagtggagtgggaccgaggtaaagatagacggagaggaccttttgattatgaaggagtctgacatcttgggcgtgatcgcttgaagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgag

SEQ ID NO: 37 - DNA, 11653 bp, Artificial Sequence
  Synthetic plasmid.
ttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaatttatgggtaccaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgcggccgctcttaagggtgatgtagccctcgccgtttttcgaatagctgtagatacattgacgggaacaaagagaaactctaagggatacactctatcattggtgaaaaagtttatttcaattgttgacggctttgaagttcttgacagagattaccttgtttcctcgattgtaactcacatgtcctcattggatcccaaatgttcggagtatattgttattgctttagcgcttccattgcgatatttgtctatttcgtcaccagagtttccaatcaagctgcagctgtctgtcaagaattatctaaagctagatgagccctcaactagaaatggctatgttgagtttttaaccaaacttttggaagcatgtagaaacgaagaaaatgatacaagagctgttttactacaacaattagtaaagaaatgcaaatgttctgtgtgatagcctttcttttttgaattcagcatgttggtttatggtgttttattgaagccatgactgagcctttttacttagatgaccacatgacttatgagacgtcaattaaggaggaccagtagaataagatcgcaatagtttctgctgtcatgatgaagcgtatatacagagccaaatcttcatgcatacaataacatattgtgtttcctcccaaataattaacaatgacttacctgtatatccaggacactcctgtactgagaccgaccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgatgtactgagaccgctctgtgctctagtattgataattggtctactactagatagatgcctaacattaatgatatagtcgtatcagtctttgctgtaaataaagcctccggaatgagatctaaagaatcagcccagatgtttggaaggagggaaagatacgcctttctactaattaagccagttttgatctcagttgattgatgtcctgtctctgcgatagctcaaaactggcaactgaaacagatagtatattaattttcagttgctaatgataagccattgtaacattcctatcacatcggccgtttgcctcttttttgggaaaactctttccagtgaatgcacagcttatcgctttcaatgcttcaaaggcaacttccctactaagacactaaatatatatacatcaatgaacatatagtgggaaaaatggtagtgaagaagtagtcatttgtttgaatataagttggctgtacatgtgcctccgtagtctgtggccgagcttcatccacctagcaattgaaactgaagagctaagctcttcatattctcattcggttctgttattctcttttacttcttcttgtcaaaatattatgtattatgtgtagtacccgaccaacatggagaattcaatctaagaaatagatgtcaccccaagccgaacaaaaacaaccggtgaagaaaacgtaactgagtgaatggaattgtgattcaagcaattagagtaattgaatttcacttctggtacgagaaataaagtgaaaaacaaaatacctccgcataattagtgacgaaaaaaaccacacgtatactattcactgagtgaaagtgcgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatctcgagggagagcaggacctccgctgtgactcttcttttttttcttttattctcactacatacattttagttattcgccaacatgtcaactaacatcaatggatacaatagtggtactaataacaaaacaggtcaagccttcgttgacgagttcttatctgaaaaaaactgcacactgcctacaagtgatgcagttgtacttgctttgatgaagacagaagaaattaacgtcattgtggatgaaatgatccgacctatgatggacgataacccagctttggccgtcgatgatagaggtggttactggtggattaaggttaatggaaaaatagttattgattgtgatgaagctacagagatattaggtaagaagtacactgtctatgactttctagttaatgtgtctactaccattggaagggccatgactttgggaaatcaattcgtcttgaccaatgagcttttgggactagaaacaaaaatcgactctgtgtactaggtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatatgaacaccagatctggcgatacccccgctatccctagactggacggacttccacaagccgttggagctacagttctgattcatgaggacggggagttcagggtgtatgctaccgagcttgagatgttgctgaggtgggacctttttcaaggcgatcgtcacttgcataccggttcagcactgcgtgtggaatcatgtattgtttctgccaaaggtaaaattggtttctttagaagacctacagtagctagattgatcgctgcaggcgatgaagcctcccctaatgatccatcatagattcggatagtgtaatttaatcaataacttgaaaaaaatatcatttaatttactatacacacggacataaactgaaagggcaaggaaggggaaaatgggaaaaataatgaggatatgcaagatgagagatgagagatgagagatgtccactttagtcagttttggctttacttttatctttttctatggcatctttcgttttactactagtatacatagaataaaaacggtaatagaactgggaactaagcagaaacttacaattcctgagaagccttggccttggcagacttctttggcaacaattcggattgaatgtttggcaagacaccaccttgggcgatggtgacgtgtcccagcaacttgttcaattcctcatcgtttctgatggccaattgcaagtgtcttgggataattctggacttcttgttgtctctggcggcgttaccggccaattccaaaatttcagcagccaagtactccaagacagcagtcaaatagactggagcaccagaaccaattctttgggcgtagttacctcttctcagaagacggtggactcttcccacagggaaggtcaaacctgccttagaagatcttgaggttgaggccttttcagccgaagatgcttttcctttaccaccggacattgttgtagttttaatatagtttgagtatgagatggaactcagaacgaaggaattatcaccagtttatatattctgaggaaagggtgtgtcctaaattggacagtcacgatggcaataaacgctcagccaatcagaatgcaggagccataaattgttgtattattgctgcaagatttatgtgggttcacattccactgaatggttttcactgtagaattggtgtcctagttgttatgtttcgagatgttttcaagaaaaactaaaatgcacaaactgaccaataatgtgccgtcgcgcttggtacaaacgtcaggattgccaccacttttttcgcactctggtacaaaagttcgcacttcccactcgtatgtaacgaaaaacagagcagtctatccagaacgagacaaattagcgcgtactgtcccattccataaggtatcataggaaacgagagtcctccccccatcacgtatatataaacacactgatatcccacatccgcttgtcaccaaactaatacatccagttcaagttacctaaacaaatcaaaatgactaatggaaagaactgtagggtatctgatggattcggagctttgggtaagctgtcatctggtatgagaatattagctgaggtcgttgctgtaacactgggtcctggaggcaggcatgtgatcctggagcatagaagtggtttggcccctagattgtctaaggatggagttgagatcgctaggactatggaagtagccggtcgtgaggaggaaatgggcgtgcgtcttttgagggacgctgctataagtattagtgccagtgtcggagatggtactacaactgccattgtcttgtctgctgccttagctacacgatgtatggccgcttcttctcatccattaaacgtttctgaaatgagatacggtctggccatggctggtgctacagtgttaagtgaattagccgccatggccagaccagctgatcaacacgcccttcaagctgtcgctaggaccgcagtgaatggagacgcacccttagcagccttgcttgctgacgcttatgcaagagtcgggagtgagggtgttattaagattgaaatgggtaatgcaatgcacgatgttctagatgttaaactgggccatcgttttgagtctttattgttggcctccggtcttcccgcttcagcaggcgagagacaacttctgaggcctcttacccttttgcatgatggtgagctggatgacctacaagccttgattccagctatggagatcgctagagccgagcaaaggcctctgttgattcttgctggtgatgtatcagatggtgtcaggacagccattgttcgtaacgctcgtgagaacgtcgttgacgttactgttgttcgtgctccaatgtttggggatactagacaagaatgtctgggagatcttgcagctctatgcggtggttcagcttttgtggagaacggttttagaacgattgccgctttgtccagggatgatcttggttcagttgatagagccgtagtcgatgctgggtctgcaatcctacacggtgcacacggagatgctagagagagacaagacaggattgctctgttgagatctgaaatggaggggtctggtagatctactgcatctccatcaggccagttggatcattccgataagtgtcaagaaagattgcaaattcttcttggagccactgcatccctgcaattaggtggggccacggacgtggctataaaggctagaatgcccattgccgaaaacggaagacgtgcattattggctgcagcatccacaggagttttgcctggaggtggagtggccatgctaagagctgcattagccgctaggtctaggctatcaactctgcaagatgatgctcgtcttggagctgaggcactactttctgctttacaagctccttttgcctgggtcgtgagaaacagtggacatcagcctgaagagtgtttggatagagttcttagtgaagctgattgtttccatggtcttgatgcagctagaggatgctatggtgacctgcacgctgcaggcgttttggattcctttttgatggtcagaaagatcgtgaccgttgccacctcaatggccggatcattactttcaacgggagccttagtgtgccgtggaggtgaaactgctctacctgagaactttcaggggacgcaacaggtttacagaaagttagcagctggtggagcttttgattcataagcgtgcttcttttttgtttctttagttgtttagtttttggcactggttttggtcgaccttttgttttaagtagcctatatatgcagttaaatgattgatagtttgatttattccgtgcaacttaagggattgtgattgggcgtggcaatctacctacattctatttacctgcaatcttaggattgagattgattcagattctcttgaaggggaagggttagactatttaaaattcatacatacagttcattcttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatgaagctgcgtccacttcatgatagagtcatcgtaaagcgattggaagaagaaaagaagtctgctggtggtataattataccagatgcagccgctgaaaagccttccagaggagaagttatcagtgtgggacctggtaagagaggggacgatggtaagttaaatgctcttgatgttaaagctggtgatatagtattgtttggtaaatattctggcagtgaggttcgtgtagatggtcaagacctactggttatgagagaagacgacattatggctgtttttgccaagtagagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggctcgag

SEQ ID NO: 38 - DNA, 4300 bp, Artificial Sequence
  Synthetic plasmid.
ggaaaccacgtaagctccggcgtttaaacacccataacagatacggactttctcaaaggagagttatcagtggcgaatatcaaaccgctggaagataaaattgttgtgcaggcaagcgaagcggaaacgaccacagccagcggcattgtgattccagacacggcgaaagaaaaaccgcaagaaggaaaggttctggcggtcggcccaggtcgtatcgatgataacggaaaccgcgttccgttagatgtagctgtcggcgatgtcgtgatctacagcaaatatggcggaacggaagtgaaatacaacggggaggaatatctgattctgtctgcgcgcgatgtgctggcagtcgtaaattgatccgcgcacgacactgaacatacgaatttaaggaataaagataatggccaaagaactgaaattcggtgttgatgcccgtcgcgctttacaggccggtgtcgatcaactggcggaagctgtcaaatcaaccctcggcccaaaaggccgtaatgttgtgttagaaaaaatcaccggaactccagaagttaccaatgatggcgtaaccattgctcgtgaaattcatctgcgcgatccgtttgaaaacatgggtgcacagatcctgaaagaagcggctatcaaaaccaacgacacggtgggcgacgggaccactaccgcgacagtggtggcccaggcaatcgttcgcgaaggcatgaaagccattcagagcggcggcaaccctgttctggtaaaacgtggtattgatttagcggtgggccgtattgttgagcgtcttgccgccgtggcccacccagtagactctctggaacacctgagccgcgtcgctgctatttctgctaatgacgacgagacgatcggtagcgtcatcgcgaaaaccctgcacaccgtgggggatgatggtgttattagcgtggatgatggtccagttctgggactcaccgtgaactttgtcgaagattttgaatttgacaatggatatgtctcaccgtatttggtaaccgacccggggagcatgatggccgttctggacgacccgtacatcttattgagcgcggaaaaaatcacggatgtccgccaactgatgccggtactggaaaaacttatgcgtgatccacgtccactcgtcattgtggccgaaaaagtggagggtacggcgctgcaaatgctggtgcataaccatgtaaacggtcacctgaaagtgactgcgattcaagcgccggggttcggggagaaacgcatccatttgctggaggatctcgccgcactgacgggtgcgaaagtccattcaaaagcgagcagttttgcgctggaacaaatgaccactgaacaccttggccgcactacacaagtccgcgccacgaatgaacaatgcgtgtttatcggtggtcatggaagcaaagaagctgttgaacagcgtctgtctcagttgcgtgctgagatggcccgcgccactatcggtacagacgaagattggttgaacgatcgtattgcacgcctgagcggcaaagcggcgatcattagtgttggagcaccgaccaacgctgaactgaaagaaatccgccatcgcgtcgatgactcactgcaagccactcgcgcagctatggctgaaggtattgtagcgggcggcggttcagcgttactgcatgccgagagcgctctggatgggttagatgtggatggcgactatcgtattggcgttgaaattgttcgcgcggctctgagtgaaccggtgcatctgatcgcgtctaatgcaggatacgatggtgcggacgtagtaaaacaagtcacggatttgggtgtggatgaaggctttgatgcgctgcaaggtcgctttggtgatatggtcgaaatgggcatcattgacccgctccgcgtcgtgcgttcagccctgcagaatggggctagcgtggctggcctgattttgacgacgaacagccttgtcgcggaagaacaaaccccttggaataaagccctgatgaccgaatttggcccgttggatgaaggtattccgcagccttctccagatagcagcacgccacagagcctcggtctgggcccgtccgtcggctaagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 39 - DNA, 4321 bp, Artificial Sequence
  Synthetic plasmid.
ggaaaccacgtaagctccggcgtttaaacacccataacagatacggactttctcaaaggagagttatcagtgaaaatccgtccgctgcatgatcgtgttattgtcaagcgtctcgaagcggagcgcaaaacggcctcaggaatcgttatcccagattcagcaggcgagaagccggaccaaggagaagttctggcggtgggtaacggtaaaatccttgacgacggtaaagtccgtccgatggccgtcaaagtgggtgataaagttctgttcggtaagtatgctggtcaaaccgtcaaagtggagggcgaggagctcctggtgatgcgtgaagaagatattatgggtgtggtggaggcttaatccgcgcacgacactgaacatacgaatttaaggaataaagataatgattagccttaattgcaaaaaaaccactaccggtctgaccgcacatttggctctggtgcgcggcatgaaagccttagcggagctggtgggtacgacattaggaccccaaggtcgccacgttatgttagcacaccgtgccgggctggcgccgcacgtaagcaaagacggtgtggaagttgcgcgtcatctgtccctgcccgattcggaagaggaattaggtgttcgcttactgcgtaatgcggctgttgcagtctccgagtcatttggcgatgggacctcaaccgccaccgtcttcaccgcggatctggccgtgcgcgcgcttaaattgattggtgccggtgcggatacattagaagttcgccgtggtctgggcttggcggcctatgctgcgctggttgcactgaacgatatggcccgccgtgcggaccgcggaatgctgacggccgtagctcaaacggccgctaacggtgaccgtcgcgtggctgacttgttagtggaggcgtttgaacgcgtgggcgcggaaggaacaattgaagtggaaatgggtaacagtgtagaggatgttttggaagtggcacaagggagctattttgataccgtgcccttggttaccgcactgctgccaccgaccggccaagtagaatttgcgcgtccgttgattcttttccattgcgatgccattgaaaccgcagatgaaattcttccggccctcgaactcgctcgttctagccgtcgcccactgcttattctggcggactccgtgggtattgatgttgaaactctgcttgtccgcaatcaaaatgaaggcaccttagcggtggcagtagtacgtgcaccgatgtatggtgacacgcgccgtgaagctctcctggatctgacgtcaaaatttggcggaactgcgttcggccgcgagggctttgtcgaattcgcgctgcgtagcttaggcagcctgagcgaaggagatctcggtcaggcggacgaggccattttggaagcagatggcgtgactttacgcggggcgggaaataacccctccgccctggaagatcgtattgcactggttcgcgcggaactggatcgcggagatgtgtccgttggggattcgccgtccgcaaaactcgactacattgagaaacgcaaagagcgcttaaaactgcttgccgccgggagcgcaaaactgcatattgggggcccgaccgatgtcgagatcaagacgcgtcttccgctggcagagaatgcgcatcgtgctttgctggccgctgccaagtctggtgttctgcctgggggcggtgtcgccatgattcgcgcggcagaaaaagtacagcaggaaatgggccgtctggagggcgatgtggcgtccggtgcctcgatttttctgcagagcttagatactcccattcgctggattgcgcgtaacgcgggtctgcgcccggacgaagtcctggcacgcacattggcaaacgaatctgatttttacggtctgaacgcgatgacgggtcgctacggcgacctggcagaagatggtgttctcgatgctctggacatggtaaccgacgttattcgtgtggcggtgtcggtagtcggaagcatgctcggagtaggcgcactggtcacgcgcgcgagtccgaaaccggcgccggaacgtttcaagggaacggagcgcgtacacgataaactgatgcgcgaaggtggttttgatgagtgagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 40 - DNA, 4306 bp, Artificial Sequence
  Synthetic primer.
tctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagcaccagcctcgagggaaaccacgtaagctccggcgtttaaacacccataacagatacggactttctcaaaggagagttatcagtgaaaatccgcccgttacatgaccgtgtcatcatcaaacgcttggaagaagagcgtacctcggcgggcgggattgtcattccagatagcgccgctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaatccgcgcacgacactgaacatacgaatttaaggaataaagataatggcgaaagaagttgtgtatcgtggtagtgcgcgccagcgtatgatgcagggtattgaaattctcgctcgcgccgctattccaacgctgggggcaaccggcccgagcgtcatgattcaacatcgcgccgatggtctgccacccatttctacacgcgatggcgttaccgtagcgaattctattgttttaaaagaccgtgtcgcgaacctgggtgcccgcctgctgcgcgacgtagccggtacaatgagccgtgaagccggcgacggcacgacgactgcgatcgtattggcccgccacatcgcccgtgagatgtttaaatcgctggccgtgggtgcagatccgatcgcgctgaaacgtggtatcgatcgcgccgttgctcgtgtgtccgaagatattggggcgcgtgcgtggcgtggcgataaagaaagcgtgatcctgggtgtcgctgctgtggcgacgaaaggcgaaccgggcgttggccgtctgctgctggaggctctcgatgcagtgggtgttcacggtgccgtttctatcgaactgggccaacgtcgtgaagatctgctggacgtcgtcgatggctatcgctgggaaaaaggttatttatctccctactttgtcacggaccgtgcccgcgaactcgcggaactggaggatgtctacctgctcatgaccgaccgcgaagtggttgacttcatcgaccttgtacctctgctggaggccgtgacggaagcaggaggctccctgctgattgccgcggatcgtgtgcacgaaaaggccttagcggggctgcttctgaatcacgtgcgcggtgtcttcaaggccgtggccgtaaccgctccgggttttggcgacaaacgcccgaaccgtttacttgacctggccgcgttaaccggcggtcgtgccgtgctcgaagctcaaggcgaccgtctggaccgtgttaccctcgcggatctgggccgtgtgcgccgtgccgtggtgtcggcagatgataccgcgctgcttggcatcccgggcaccgaagctagccgtgcacgcctcgaaggtctgcgtttagaagcagagcagtaccgtgcgctgaaaccagggcagggttctgccaccgggcgcctgcacgaacttgaagaaattgaagcgcgcattgtgggtctgtccggaaagagcgccgtttatcgcgtcggaggtgtgaccgatgtggaaatgaaagagcgcatggttcgcatcgaaaacgcttaccgttcggtggtaagtgcgctggaggaaggcgtgctccctggcggtggtgtcggctttctgggtagtatgccggtgcttgcggaattggaggcccgcgacgcagatgaagctcgcgggattgggattgtacgcagcgccttaacggagcctcttcgtattatcggcgaaaatagtggcttgagcggtgaagccgttgttgccaaagtcatggatcatgccaacccgggatggggttacgaccaggagtctggctctttttgcgacctgcatgcgcgtgggatctgggatgctgctaaagtgttacgtctcgcgttggagaaggcagcctctgttgctgggacctttctgacaaccgaagctgttgttctcgaaattccggatacagatgcgttcgcagggttcagtgcagaatgggctgccgccacgcgcgaagatccgcgcgtatgagtttaaacgcggccgcaatttgaacgccagcacatggactctcgag

SEQ ID NO: 41 - DNA, 4357 bp, Artificial Sequence
  Synthetic plasmid.
ggaaaccacgtaagctccggcgtttaaacacccataacagatacggactttctcaaaggagagttatcagtggcgtttcgtccgctgcacgatcgtgtggtggttaaacgtctggaaggcgaggacaaaactaaaggtgggattattatcccggatacggctaaagaaaaaccagcggaaggtaaggtcatcgcagtaggtccaggttcccgtgatgaaagcggcaaactggttgcgctggatgtgaaagaaggcgatcgtgtgctgttcggcaagtggagcggcacagaagtcaaaatcgatggagaagatttgcttattatgaaggaatctgatatcctgggcgtaatcgtataatccgcgcacgacactgaacatacgaatttaaggaataaagataatgactaatccgcgtaaacgcgaacgccgtcgtccggcattcgatgtcacacgtgaaaaattcgttgcccgtaacattcgctttggtgatgtggtccgccgtgatttattagcgggcgtggatgcccttgcagacgcggtagcggtgaccttaggcccgcgcggccgtaacgttgtaatcgaacatcgcgcggcaggtttgccgccagtagcaaccaaagatggagtgaccgtagcgcaggccgtggaattggcgggtcgcacccagtccgtcggtgtgagcttagtacgccagatggcgacggctgtagccaaggaggcgggcgatgggaccaccacgagcgttgtgcttgctcgtcgcttggcagccgaaacccgcaaagccctggcagctgggatgaatccgcgtgatatcgtactggggatggaaaaagcggcccgcattgtggatcgtgacctcgcggctcgtgcacgccgttgcgatgacacacgtgcccttgcgcacgtcgctaccttggctgccgggggtgatgagagtatcggtgccattgtggcggatgctttaacacgtgcgggcgagggcggcgtagtagacgtggaactgggtgctgcactgtgtgatgagatggacattgttgagggcatgcgctgggaacagggttaccgctcaccgtatttcatgacggactctgcgcgcaagatcgcagaactggaaaatccttacattctgatctacgatcgtgttattaatcaattttccgaattagttccggcgttagaattagtccgtcgccaacgcggcagcctgttaatcgtcgctgaaaacattgtggaagaggccctccctggcctgctcctgaatcatattcgtaaaaatctgtgttctatcgccgttaaaggtccgggttatggggactcccgttacgaatttctgcacgatctggcggccttaaccggaggccgtgcgatcatggaggcgtgcggcgaggagttgtcaaacgttaccatggcccatctgggacgcgcaaaacgtgtagtggtgcgcgaagatgatacggttgtgatcggcggggagggggacggtgcggccatcactgagcgtctggccgcggcgcgtcagcaggcagattggattaccgacggcgatccaagcaaaggaagcccatccggaaagcgccacgatttagaaaacctgcagacccgcattaaagctctgagcggaaaggtagtcacgattaaggccggcggccttagtgatattctgattaaagaacgcatgcagcgtattgagaatgctctcgcatcggcgcgcgcagcccgctccgacggagtcgtggccggcggcggcgtgggactgtatcgcgcccgcgctgcgttgactgaggcaacgggcgacaccttggatcaaacctacggcattgcgattgtacgcgctgctctcgacgagcccattcgccgtattgctgcgaacgcggggcgcgatgcacatgaatttctgtttgaactcaaacgctctaacgatgatttttgggggatggatatgcgcagcggtgaatgcggagatctttatgccgcgggcgtcattgatccggcgcgtgttacccgcctggccctgcgcaacgcggtagctacggctagcagcctgatgaccgtcgaatgcgcagtaactcatatcccaccttctgaccccacctatggttttgatcctcatttggcggcggcaacccgtgaagacccgcgctcataagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 42 - DNA, 4297 bp, Artificial Sequence
  Synthetic plasmid.
ggaaaccacgtaagctccggcgtttaaacacccataacagatacggactttctcaaaggagagttatcagtgaacattcgtccgctcaatgatcgcgtgattgtaaaacgtcttgaagaggaacgcacgtcaccgggtggcattgtgatcccggattcagccacagagaaaccgtcccgtggtgaaatcctggcggtcggcacgggtaaaaccctggataatggtcaggtacgtgccttggccgtcaaagcgggcgacaaagtgctgtttggtaaatacgcggggacggaagtcaagattgacggccaggagattcttgtgatgcgtgaagaagatattattgcggtgcttgaggattaatccgcgcacgacactgaacatacgaatttaaggaataaagataatgtcaaagcgcctcgtcttcgatggcgaagcccgcgcgggaattttaaaaggtattgatattttgggtcgtgcggttgagactacttacggttatcaggggccttgcgtaatggtacaacaccgcactcagggtctgcctccgttctttacacgtgatggcgtaacggttgcgaactcggtcgttctgggtgatcgcctggccgatcttggcgcacgtatgctgcgtgacgttgcgaacgcggtatctcgcgaagcgggtgatggcacaacaaccgccgtggtgctggcgcgcgcaatcgcgcgcggccttttacgttccttggcagcgggggcggatccgcatcgtttgcgcgagggaatggacgctgccgttaagctggtggaggatgatctgcgccgccgcgcgctgcctcttcaaggggatatggttgctcaagttgcagaagtgtcaatgcgcaaagaagggcaggttggccgcttactgcaacaggcttatgcggaagttggaccagatggggctgttacggtagaaccgggttggacacgtgcggataccttggatatcggcgaaggcttccgttatgaactgggatttctgtccccgggcttcgaaacagatccggttcgtcgtgccgctgacatcgagggtgcccgcgtgctgctgtatcatggtacggttactgacttcatggacctgattccgttgctggaagcagtgaatgaggctggtcaagcgctggtaattgcatgcgatggaatcgatgagcgtccgttacagggcttagtaatgaacgtcaagcgtggtgtgttccgtgcgctggcagtgaaagcgccgggccatggtgaccgtcgtcgtgattggctggatgatctggcgactgccacgggtgcccgcgtactggtgccggagcgcggagacaatctggaacgtgcggcaccggaagtgcttggacacgcggccaaagtggtggccgatgcggacagcgctagttttattggctgtggcggtgaccctgtggcagtagcccgtcgtgtggcgggattaggtaaagaggccgatgccattcgcgcgcgcaaaccgggcgaaggttctcctaccggcaatctgcatgatctggaggatctggaggcgcgcattagtgcgttagttggtcgcatcgctaccgtccgtgtaggcggcaccaccgagcccgaaattaaagaacgcttgcaacgcgctgaaaatgcccgtcgttcagttcgcgccgcgttggaggaaggagttgtgcctggcggtggagtgggactgcttcaagcccgcgaagccttaggtcgccttctcctgacggatctggactggcagcgcggcgtggctatcgtaagcgaagcactcgaacagccattccgtgctctggtcggaaacgcaggtatcaatccggtggcggccctggctcgtatcgaagcggcaggcaacgctcgttttggttacgatgccagctcaggagcgttcggtgatctcgtagcagccggtgtcttagacccagtgaaagtcctgcgcctggctctggttcaagctgcggggattgccgcgacagttctgtcttccggagcagtcgtgttgaatgagcagtcaggcttaccgcatctgcccggcttttccgcggaatgggccgcagcaacgcgcgaagatccgcgtgcctaagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 43 - DNA, 4294 bp, Artificial Sequence
  Synthetic plasmid.
ggaaaccacgtaagctccggcgtttaaacacccataacagatacggactttctcaaaggagagttatcagtggcgttccgcccgctgcatgatcgtgtggtcgttaagcgcctggagggtgaagataaaaccaaaggcggtattatcattccggatacagcgaaagaaaaaccggccgaaggcaaaatcatcgctgtaggaccgggcgcgcgcgatgaatcaggaaaattggtggcgcttgatgtcaaagaaggggaccgcgtgctgttcggaaagtggtcggggacagaggtaaaaattgatggcgaagatctgttaatcatgaaggaaagtgatattctgggcgttatcgcgtaatccgcgcacgacactgaacatacgaatttaaggaataaagataatggcgcgtaatattcgctttggtgatccggtccgtaaacgtctgctggatggcgtggattttctggcggatgccgtgggggtgactctgggtccgtgtggtcgcaacgtcgtgattgaacatcgtgcaagcggcttgccgccagtagcgactaaagatggagcaacggttgcccaagctgtggaagctgcgggtcgtaccgagtctgtaggcatcaacttggtacgtcagatggcgaccaccgtggcgaaggaagcgggagatggtacaacgacgtccgtagtgttaacccgccgtgtcgcagccgaaacacgtaaggcattagcagcgggtatgaatccgcgtgatattaccctgggaatggagcgtgctgcccgtgcagtagaggcagatttgctccgccgcgcacgtcgctgcaacgaccagcgttctcttgcgcacgttgcgactctggccgctggtggagacgaaggcattggcgcaattgtggcccaagcgctggctttagctggggaaggtggtgtggtggatgtggaattaggtcacggtgtggccgacgacatcgaaagcgtcgaaggcatgcgctgggaacagggttatcgcagcccgtattttatgaccgatagcgctcgcaaagtggccgaactggaaaacccgtacattttagtttatgaccgtgtgattaacgagttttctgaactggtgccggcccttgagctggtccgccgctccgggggctctctgttagtagtggctgaaaacattatggaagaagctctcccgggtctgctgctgaatcatattcgcaaaaacctgtgtagcattgccgtgaagggccctggttatggcgattctcgctatgaatatttactggaccttgccgcgattaccggtggccgtgcaatcatggaagccttcggtgaagacatttcaaatgtcaccatggagcatctgggccgcgcacgtcgcgtcgtagtacgtgaagatgacacactggtcattggcggcgagggcgacccaaacgtgatcgccgaccgtctggcatccgcgaaacgtcaggccgattggattgtagaaggagacgcatcaaaaggcagcccgtccggcaaacgccacgaacttgaaaatcttcagacgcgcattaaagcacttagcggtcgcatggccaccatccgcgcgggtggcctctccgatgttcttatcaaagagcgcatgcaacgtattgaaaacgcgctgaatagtgctcgcgcggcgcagtccgatggcgttgtcgcgggtggtggcgtgggcctgtaccgcgctcgcgcagcgctggctgaactgcgcggcgaaaatctggaccagagccacggagttgcgattgtgcgtgccgcgctggatgagccgattcgtcgcattgcggcgaacgcgggcgttgatgcggatgagtttctgtttgaactgcgccgttcaaatgatgatttttggggtatggacatgcgtagtggcgcgtgcggagatctgtttgcagcgggtgtgattgatccagtccgcgttactcgcctggcgttacgcaacgcggtggctactgcggcttcgcttatgacggtggagtgcgcggttacccatattcccgtgagcgacccgacattcggctttgacgcgcgtcgcgcagccgagactcgtgaagatcctcgcgcctaagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 44 - DNA, 4315 bp, Artificial Sequence
  Synthetic plasmid.
accagcctcgagggaaaccacgtaagctccggcgtttaaacacccataacagatacggactttctcaaaggagagttatcagtgaaactgcgcccgctccatgaccgtgtaattgtcaaacgtctggaagaagaaaaaaaatccgccggcggaattatcatcccggatgccgcagcagaaaagccaagtcgtggtgaagtaatcagcgtggggccggggaaacgtggcgacgatggtaaactgaatgcactggatgtgaaagctggtgatattgttttattcggcaaatactctggtagtgaagtccgcgtagacggtcaagatttgctggttatgcgcgaagacgacattatggcggtttttgccaagtaatccgcgcacgacactgaacatacgaatttaaggaataaagataatgacgaatggcaagaattgccgtgtctcggacggatttggtgccctgggcaaactgagcagtggcatgcgtatcctggcggaagtcgttgcagttaccctcggtccaggcggtcgccatgtgattctggaacatcgcagcggcttagctcctcgtctgagtaaggatggtgtcgagatcgcccgtactatggaagtggctggacgtgaagaagaaatgggtgtacgtctgttgcgcgatgcggcaatctcgattagcgctagcgtgggtgatggaacaactacagcgatcgtattgtcagctgcgctggccacgcgctgtatggctgcttccagccatccgcttaacgtctcggaaatgcgctacggattggctatggcgggggcgacagtgctctctgaattagctgccatggcgcgtccggccgatcaacatgccctgcaagcggtggcgcgcacagctgttaatggtgatgcgccgctggccgccctgcttgcggatgcctatgcccgcgtgggtagcgaaggtgttattaaaatcgagatgggtaatgcaatgcatgacgtgttagatgtgaagctcggacaccgcttcgaatccctgctgctggccagcggtctgccggctagtgcgggcgaacgtcaactcctgcgccctctgaccctgcttcacgacggcgaattggatgacctccaagcgctgattcctgcgatggagattgctcgtgccgaacaacgcccgcttctcattctggccggcgacgtcagcgatggcgtgcgcaccgcgattgtgcgtaacgctcgcgaaaatgtggtagatgttactgtagtgcgcgctccgatgtttggggatacccgtcaggaatgcctgggtgacctggccgcgctgtgcggaggatcagccttcgtggaaaacggatttcgcactattgcggccctgagccgcgatgatctgggcagcgtggatcgtgcggtggtagatgcgggaagcgctattctccacggagctcatggcgatgcacgcgaacgccaagaccgtatcgcgttgcttcgtagcgaaatggaaggtagtggtcgctcgacggcgtcgccgtctggccagctggatcatagcgacaagtgtcaagaacgcctgcagattctgcttggcgcgaccgcctcgttgcagctgggcggcgcaacggacgtcgcaatcaaagcccgcatgccgatcgccgaaaatgggcgccgcgcgttactggccgcagcgagcaccggcgtcctgccgggtggaggcgtggcgatgcttcgcgcagcactcgcggcacgttcgcgcctgtctactctgcaggacgacgcccgtctcggtgcagaggcgctcttgtcagcgctgcaggccccgttcgcatgggtcgttcgcaactcgggacaccaacctgaggaatgcctggatcgcgtgttgtctgaagcggattgctttcacggcctggacgccgcccgcgggtgttacggtgatctgcatgcggcgggagtgttagattcgttcttgatggtccgcaaaattgtgacggtggcgacctctatggccggtagcctgctgagcacgggtgccttagtgtgtcgtggcggggaaactgctctcccggaaaacttccaggggacacaacaggtgtaccgcaaattagcggcaggcggcgccttcgattcttaagtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagc

SEQ ID NO: 45 - DNA, 10837 bp, Artificial Sequence
  Synthetic plasmid.
gacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgccctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacggctagctcagtcctagggataatgctagcaccagcctcgagggaaaccacgtaagctccggcgtttaaacacccataacagatacggactttctcaaaggagagttatcagtgaaaatccgcccgttacatgaccgtgtcatcatcaaacgcttggaagaagagcgtacctcggcgggcgggattgtcattccagatagcgcagctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaatccgcgcacgacactgaacatacgaatttaaggaataaagataatggcgaaagaagttgtgtatcgtggtagtgcgcgccagcgtatgatgcagggtattgaaattctcgctcgcgccgctattccaacgctgggggcaaccggcccgagcgtcatgattcaacatcgcgccgatggtctgccacccatttctacacgcgatggcgttaccgtagcgaattctattgttttaaaagaccgtgtcgcgaacctgggtgcccgcctgctgcgcgacgtagccggtacaatgagccgtgaagccggcgacggcacgacgactgcgatcgtattggcccgccacatcgcccgtgagatgtttaaatcgctggccgtgggtgcagatccgatcgcgctgaaacgtggtatcgatcgcgccgttgctcgtgtgtccgaagatattggggcgcgtgcgtggcgtggcgataaagaaagcgtgatcctgggtgtcgctgctgtggcgacgaaaggcgaaccgggcgttggccgtctgctgctggaggctctcgatgcagtgggtgttcacggtgccgtttctatcgaactgggccaacgtcgtgaagatctgctggacgtcgtcgatggctatcgctgggaaaaaggttatttatctccctactttgtcacggaccgtgcccgcgaactcgcggaactggaggatgtctacctgctcatgaccgaccgcgaagtggttgacttcatcgaccttgtacctctgctggaggccgtgacggaagcaggaggctccctgctgattgccgcggatcgtgtgcacgaaaaggccttagcggggctgcttctgaatcacgtgcgcggtgtcttcaaggccgtggccgtaaccgctccgggttttggcgacaaacgcccgaaccgtttacttgacctggccgcgttaaccggcggtcgtgccgtgctcgaagctcaaggcgaccgtctggaccgtgttaccctcgcggatctgggccgtgtgcgccgtgccgtggtgtcggcagatgataccgcgctgcttggcatcccgggcaccgaagctagccgtgcacgcctcgaaggtctgcgtttagaagcagagcagtaccgtgcgctgaaaccagggcagggttctgccaccgggcgcctgcacgaacttgaagaaattgaagcgcgcattgtgggtctgtccggaaagagcgccgtttatcgcgtcggaggtgtgaccgatgtggaaatgaaagagcgcatggttcgcatcgaaaacgcttaccgttcggtggtaagtgcgctggaggaaggcgtgctccctggcggtggtgtcggctttctgggtagtatgccggtgcttgcggaattggaggcccgcgacgcagatgaagctcgcgggattgggattgtacgcagcgccttaacggagcctcttcgtattatcggcgaaaatagtggcttgagcggtgaagccgttgttgccaaagtcatggatcatgccaacccgggatggggttacgaccaggagtctggctctttttgcgacctgcatgcgcgtgggatctgggatgctgctaaagtgttacgtctcgcgttggagaaggcagcctctgttgctgggacctttctgacaaccgaagctgttgttctcgaaattccggatacagatgcgttcgcagggttcagtgcagaatgggctgccgccacgcgcgaagatccgcgcgtatgagtttaaacgcggccgcaatttgaacgcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaagtttaaacgcggccgcaatttgaacgccagcacatggactcccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaacccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatttcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcaattgaccaacaaggacgtcaatagagttaaggagggaggggatgaaagccgccgtggtcgagcaattcaaaaaaccactccaggtgaaagaggtcgaaaaaccgaaaattagttacggtgaagtgctggttcgtattaaagcttgtggtgtctgccacaccgatctgcatgccgcacacggcgattggccggtaaaaccgaaactgccgctcatccccggccatgaaggcgtaggcgtcatcgaggaagtcggcccgggtgtgacacaccttaaagttggcgatcgtgtgggcattccctggctgtattcggcgtgtggccactgtgactattgtctcagcggccaggagactctgtgcgaacgccagcagaacgccggctacagcgttgatggtggctacgccgagtactgtcgtgctgcggcagattacgtggtgaagattcctgataatctttcctttgaagaagcggcgcccattttatgcgcgggcgttaccacttataaagcgctgaaagtcaccggtgccaaaccaggcgagtgggtggccatttatggaattgggggcctcggccatgtggcagttcagtacgctaaagcaatgggcttaaacgtcgtggcagtggacttgggagatgaaaagctggaactggcaaaacaactgggcgcggacctggtagtgaatccgaaacatgatgatgcagcacaatggattaaagaaaaagttggtggcgtgcatgccacggtggtgacggcagttagtaaagccgcttttgaatcggcgtataagtcaatccgccgcggaggagcatgcgtccttgttggtctgccaccggaggaaatccccattccgatttttgacacagttctgaacggcgtcaaaattatcggttcaattgttggcacccgtaaagacctgcaggaagccctccagtttgctgctgaaggcaaagtgaaaactatcgtggaagttcagccgcttgagaacattaacgacgtatttgatcgtatgctgaaaggacagattaatggacgtgtggtcctgaaagtggattgacatgctaaggtgctggctgcatgctaagttgatacgcctgcgacaaatttttctaggagcgttagtatggagaacatggataaggatttacagagcatccaggaagtacgcacccttatcgcaaaggctaagaaagcacaggccgaatttaagaacttctctcaagaggcggttaacaaagtcattgagaagatcgcaaaagccacggaggtagaggccgtgaagcttgcgaagttagcttatgaggatacaggatacggtaaatgggaggacaaggtaattaaaaacaaattttcctctatcgtagtatacaactatattaaagaccttaagacggtaggtattttgaaagaggataaagaaaagaagcttatcgacatcgcggtaccattgggggtaatcgcgggccttattccaagtacgaaccctactagcaccgcgattttcaaggtattaattgcattgaaggcgggcaatgccattgtgttcagccctcacccaacggcggttcgtagcattactgagaccgtcaaaatcatgcaaaaagcggcggtcgaagcaggtgctcctgatggattaattcagtgcatgtcgattttaactgtcgaaggaaccgctgaattgatgaagaacaaggataccgcactgattttagccaccgggggcgagggaatggtacgtgctgcctacagttcaggcacgcctgcgatcggtgtggggcccggcaatggcccttgctttattgagcgcaccgctgacattcctacggctgtccgcaaagtgattggctcggatacattcgataatggtgtgatctgcgcatcggagcaaagtattatcgcagagacggttaaaaaggccgagatcattgaagaattcaaacgtcagaaaggttatttcttgaacgccgaagaatcagagaaagtgggaaagattttattgcgcgccaacgggacacctaacccagcgatcgtgggaaaggatgtccaagcattagccaagttagcaggtatttcgatcccgagcgacgcggttatcctgttatctgaacagacggacgtatcgcccaagaatccgtatgcaaaagagaaactggccccggtcttagctttttacactgtggaagattggcatgaagcctgtgagaagtcattggcccttttgcataaccaaggaagcgggcataccttaatcattcattctcagaacgaggaaattatccgcgagtttgcgcttaaaaagccagtaagtcgtatcttggttaacagccccggctcacttggaggaattggaggcgctacgaatttagtcccaagcctgactttagggtgcggtgcagtcggtggttcagccaccagcgataatgttggtccggagaatttatttaatatccgcaaggtggcttatggtacgacaaccgttgaagaaattcgtgaggccttcggagtgggtgcagccagctcaagtgcgcccgccgagccggaggacaatgaagacgttcaagcaattgtgaaagcaatcatggccaagcttaatttgtaagtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttcggtccgttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccgacgaccgggtcatcgtggc

SEQ ID NO: 46 - DNA, 16374 bp, Artificial Sequence
  Synthetic plasmid.
ccggaaggagctgactgggttgaaggctctcaagggcatcggtcgagatcccggtgcctaatgagtgagctaacttttgacggctagctcagtcctagggataatgctagcaccagcctcgagggaaaccacgtaagctccggcgtttaaacacccataacagatacggactttctcaaaggagagttatcagtgaaaatccgcccgttacatgaccgtgtcatcatcaaacgcttggaagaagagcgtacctcggcgggcgggattgtcattccagatagcgcagctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaatccgcgcacgacactgaacatacgaatttaaggaataaagataatggcgaaagaagttgtgtatcgtggtagtgcgcgccagcgtatgatgcagggtattgaaattctcgctcgcgccgctattccaacgctgggggcaaccggcccgagcgtcatgattcaacatcgcgccgatggtctgccacccatttctacacgcgatggcgttaccgtagcgaattctattgttttaaaagaccgtgtcgcgaacctgggtgcccgcctgctgcgcgacgtagccggtacaatgagccgtgaagccggcgacggcacgacgactgcgatcgtattggcccgccacatcgcccgtgagatgtttaaatcgctggccgtgggtgcagatccgatcgcgctgaaacgtggtatcgatcgcgccgttgctcgtgtgtccgaagatattggggcgcgtgcgtggcgtggcgataaagaaagcgtgatcctgggtgtcgctgctgtggcgacgaaaggcgaaccgggcgttggccgtctgctgctggaggctctcgatgcagtgggtgttcacggtgccgtttctatcgaactgggccaacgtcgtgaagatctgctggacgtcgtcgatggctatcgctgggaaaaaggttatttatctccctactttgtcacggaccgtgcccgcgaactcgcggaactggaggatgtctacctgctcatgaccgaccgcgaagtggttgacttcatcgaccttgtacctctgctggaggccgtgacggaagcaggaggctccctgctgattgccgcggatcgtgtgcacgaaaaggccttagcggggctgcttctgaatcacgtgcgcggtgtcttcaaggccgtggccgtaaccgctccgggttttggcgacaaacgcccgaaccgtttacttgacctggccgcgttaaccggcggtcgtgccgtgctcgaagctcaaggcgaccgtctggaccgtgttaccctcgcggatctgggccgtgtgcgccgtgccgtggtgtcggcagatgataccgcgctgcttggcatcccgggcaccgaagctagccgtgcacgcctcgaaggtctgcgtttagaagcagagcagtaccgtgcgctgaaaccagggcagggttctgccaccgggcgcctgcacgaacttgaagaaattgaagcgcgcattgtgggtctgtccggaaagagcgccgtttatcgcgtcggaggtgtgaccgatgtggaaatgaaagagcgcatggttcgcatcgaaaacgcttaccgttcggtggtaagtgcgctggaggaaggcgtgctccctggcggtggtgtcggctttctgggtagtatgccggtgcttgcggaattggaggcccgcgacgcagatgaagctcgcgggattgggattgtacgcagcgccttaacggagcctcttcgtattatcggcgaaaatagtggcttgagcggtgaagccgttgttgccaaagtcatggatcatgccaacccgggatggggttacgaccaggagtctggctctttttgcgacctgcatgcgcgtgggatctgggatgctgctaaagtgttacgtctcgcgttggagaaggcagcctctgttgctgggacctttctgacaaccgaagctgttgttctcgaaattccggatacagatgcgttcgcagggttcagtgcagaatgggctgccgccacgcgcgaagatccgcgcgtatgagtttaaacgcggccgcaatttgaacgcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaagtttaaacgcggccgcaatttgaacgccagcacatggactcccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggtgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgactatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgctaggtcgttcggctgcaacaacaagacccatcatagtttgcccccgcgacattgaccataaattcatcgcacaaaatatcgaacggggtttatgccgcttttagtgggtgcgaagaatagtctgctcattacccgcgaacaccgccgcattcagatcacgcttagtagcgtccccatgagtaggcagaaccgcgtccaagtccacatcatccataacgatcatgcacggggtggaatccacacccagacttgccagcacctcattagcgacacgttgcgcagcggccacgtccttagccttatccacgcaatctagaacgtactgcctaaccgcgaaatcagactgaatcagtttccaatcatcgggcttcaccaaagcaacagcaacgcgggttgattcgacccgttccggtgcttccagaccggcgagcttgtacagttcttcttccatttcacgacgtacatcagcgtctatgtaatcaatgcccaaagcacgcttagccccacgtgaccaggacgaacgcaggtttttagaaccaacctcatactcacgccaccgagccaccaaaacagcgtccatatcctcgccggcgtcgctttgatcggccaacatatccaacatctgaaacggcgtgtacgaccccttagacgcggttttagtagcggagccagtcagttcctgagacatgcccttagcgaggtaggttgccattttcgcagcgtctccaccccaggtagacacctgatcaagtttgaccccgtgctcacgcagtggcgcgtccataccggccttaaccacaccagcagaccagcgggaaaacatggaatcctcaaacgccttgagttcatcgtcagacagtggacgatccaagaacaacagcatgttgcggtgcaagtgccaaccgttcgcccaagagtctgtgacctcatagtcactataggtgtgctccaccccgtaccgtgcacgttctttcttccactgagatgttttcaccatcgaagagtacgcagtcttaatacccgcttcaacctgcgcaaatgactgtgagcggttgtgtcgaacagtgcccacaaacatcatgagcgcgccacccgccgccaagtgattcttagtagcaatagccagctcaatgcggcgttcgcccatgacttccaattcagccagaggtgacccccagcgagagtgagagttttgcagaccctcaaactgcgaagcaccgttagacgaccaggacaccgcaacagcttcgtccctgcgccacctatggcaccccgccagagccttactattggtgatcttgtacatgacgttttgcctacgccacgccctagcgcgagtgaccttagaaccctcattgacctgcggttccttagaggtgttcacttctatttcagtgttacctagacccgatgttgtgcggggttgcgcagtgcgagtttgtgcgggtgttgtgcccgttgtcttagctagtgctatggttgtcaattgaaaccccttcgggttatgtggcccccgtgcatatgagttggtagctcgcacgggggtttgtcttgtctagggactattaatttttagtggtgtttggtggccgcctagcttggctatgcgtgccagcttacccgtactcaatgttaaagatttgcatcgacatgggagggttacgtgtccgatacctagggggggtatccgcgactaggtgccccggtgctcactgtctgtaccggcggggcaagccccacaccccgcatggacagggtggctccgccccctgcacccccagcaatctgcatgtacatgttttacacattagcacgacatgactgcatgtgcatgcggcgagcggtatcagctcacctgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 47 - DNA, 7515 bp, Artificial Sequence
  Synthetic plasmid.
tgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctccaggtaacagaaagttaacctctgtgcccgtagtccccagggaataataagaacagcatgtgggcgttattcatgataagaaatgtgaaaaaacaaagacctgttaatctggacctacagaccatccggttccccatcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcgtatcacgtcgtcgtaggtattcgccacatgatgatggattttggctatctggaagaaacattcgaagcgggtaaacgctccgccaaaatctcctttgttattactgtcgtgctttcacttctcgcaggagtcctcgtatggtaagcaacgcctccgcattaggacgcaatggcgtacatgatttcatcctcgttcgcgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggctttgcgcctgatgctgcaactggtgattgtcgttgcactggtggtttacgtgatttatggattcgttgtggtgtggggtgtgtgatgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaaacctgtttcctgtgtgaaattgttatccgctcacaattccacacattatacgagccggatgattaattgtcaagtgtaggctggagctgcttcgaagttcctatactttctagagaataggaacttcggaataggaacttcatttaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaactaaggaggatattcatatggaccatggctaattcccatgtcggttccttcgcgagccactacgtagacaagagctcgcaagtgaaccccggcacgcacatcactgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataa

SEQ ID NO: 48 - DNA, 2676 bp, Escherichia coli
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttacaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaaaagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 49 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFTTHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEKLALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 50 - DNA, 1032 bp, Artificial Sequence
  Synthetic plasmid.
atgaaagccgccgtggtcgagcaattcaaaaaaccactccaggtgaaagaggtcgaaaaaccgaaaattagttacggtgaagtgctggttcgtattaaagcttgtggtgtctgccacaccgatctgcatgccgcacacggcgattggccggtaaaaccgaaactgccgctcatccccggccatgaaggcgtaggcgtcatcgaggaagtcggcccgggtgtgacacaccttaaagttggcgatcgtgtgggcattccctggctgtattcggcgtgtggccactgtgactattgtctcagcggccaggagactctgtgcgaacgccagcagaacgccggctacagcgttgatggtggctacgccgagtactgtcgtgctgcggcagattacgtggtgaagattcctgataatctttcctttgaagaagcggcgcccattttatgcgcgggcgttaccacttataaagcgctgaaagtcaccggtgccaaaccaggcgagtgggtggccatttatggaattgggggcctcggccatgtggcagttcagtacgctaaagcaatgggcttaaacgtcgtggcagtggacttgggagatgaaaagctggaactggcaaaacaactgggcgcggacctggtagtgaatccgaaacatgatgatgcagcacaatggattaaagaaaaagttggtggcgtgcatgccacggtggtgacggcagttagtaaagccgcttttgaatcggcgtataagtcaatccgccgcggaggagcatgcgtccttgttggtctgccaccggaggaaatccccattccgatttttgacacagttctgaacggcgtcaaaattatcggttcaattgttggcacccgtaaagacctgcaggaagccctccagtttgctgctgaaggcaaagtgaaaactatcgtggaagttcagccgcttgagaacattaacgacgtatttgatcgtatgctgaaaggacagattaatggacgtgtggtcctgaaagtggatcatcatcaccatcaccactga

SEQ ID NO: 51 - protein, 343 aa, Escherichia coli
MKAAVVEQFKKPLQVKEVEKPKISYGEVLVRIKACGVCHTDLHAAHGDWPVKPKLPLIPGHEGVGVIEEVGPGVTHLKVGDRVGIPWLYSACGHCDYCLSGQETLCERQQNAGYSVDGGYAEYCRAAADYVVKIPDNLSFEEAAPILCAGVTTYKALKVTGAKPGEWVAIYGIGGLGHVAVQYAKAMGLNVVAVDLGDEKLELAKQLGADLVVNPKHDDAAQWIKEKVGGVHATVVTAVSKAAFESAYKSIRRGGACVLVGLPPEEIPIPIFDTVLNGVKIIGSIVGTRKDLQEALQFAAEGKVKTIVEVQPLENINDVFDRMLKGQINGRVVLKVDHHHHHH

SEQ ID NO: 52 - DNA, 951 bp, Escherichia coli
atgagtaagcgtaaagtcgccattatcggttctggcaacattggcaccgatctgatgattaaaattttgcgtcacggtcagcatctggagatggcggtgatggttggcattgatcctcagtccgacggtctggcgcgcgccagacgtatgggcgtcgccaccacccatgaaggggtgatcggactgatgaacatgcctgaatttgctgatatcgacattgtatttgatgcgaccagcgccggtgctcatgtgaaaaacgatgccgctttacgcgaagcgaaaccggatattcgcttaattgacctgacgcctgctgccatcggcccttactgcgtgccggtggttaacctcgaggcgaacgtcgatcaactgaacgtcaacatggtcacctgcggcggccaggccaccattccaatggtggcggcagtttcacgcgtggcgcgtgttcattacgccgaaattatcgcttctatcgccagtaaatctgccggacctggcacgcgtgccaatatcgatgaatttacggaaaccacttcccgagccattgaagtggtgggcggcgcggcaaaagggaaggcgattattgtgcttaacccagcagagccaccgttgatgatgcgtgacacggtgtatgtattgagcgacgaagcttcacaagatgatatcgaagcctcaatcaatgaaatggctgaggcggtgcaggcttacgtaccgggttatcgcctgaaacagcgcgtgcagtttgaagttatcccgcaggataaaccggtcaatttaccgggcgtggggcaattctccggactgaaaacagcggtctggctggaagtcgaaggcgcagcgcattatctgcctgcctatgcgggcaacctcgacattatgacttccagtgcgctggcgacagcggaaaaaatggcccagtcactggcgcgcaaggcaggagaagcggcatga

SEQ ID NO: 53 - protein, 316 aa, Escherichia coli
MSKRKVAIIGSGNIGTDLMIKILRHGQHLEMAVMVGIDPQSDGLARARRMGVATTHEGVIGLMNMPEFADIDIVFDATSAGAHVKNDAALREAKPDIRLIDLTPAAIGPYCVPVVNLEANVDQLNVNMVTCGGQATIPMVAAVSRVARVHYAEIIASIASKSAGPGTRANIDEFTETTSRAIEVVGGAAKGKAIIVLNPAEPPLMMRDTVYVLSDEASQDDIEASINEMAEAVQAYVPGYRLKQRVQFEVIPQDKPVNLPGVGQFSGLKTAVWLEVEGAAHYLPAYAGNLDIMTSSALATAEKMAQSLARKAGEAA

SEQ ID NO: 54 - DNA, 1476 bp, Artificial Sequence
  Synthetic plasmid.
atggagataatggataaggacttacagtcaatacaggaagtaagaactcttatagcaaaagcaaagaaagctcaagcagaatttaaaaatttttctcaagaagctgtaaacaaggtaatagaaaaaatagctaaggctacagaagttgaagctgtaaaacttgcaaaattggcatatgaagatacaggatatggaaaatgggaagataaagtaataaagaataagttttcaagtatagtagtttataactatattaaagatttgaaaacggttggaattttaaaagaagacaaggaaaagaaattaatagatatagctgttccacttggagttatagcaggacttataccttcaactaacccaacttcaacagcaatattcaaggtattaatagcattaaaggcaggaaatgcaatagtattctcaccacatccaacagcagtaagaagtattacagaaactgtaaagataatgcagaaagctgcagtagaagcaggagcaccagatggattaatccaatgtatgtcaatattgacagtagaaggtactgctgaattgatgaagaataaggatacagcacttatccttgcaacaggtggagaaggaatggtaagagcagcttacagttcaggaacaccagctataggagttggacctggaaacggcccatgctttattgaaagaacagcagatattcctacagcagtaagaaaagtaataggcagtgatacttttgataatggagtaatatgtgcttcagaacaatcaataatagcagagacagtaaagaaagcagagataattgaagaattcaagagacaaaaaggatatttcttaaatgcagaagaatcagaaaaagtaggcaagattttattaagagctaatggaacaccaaacccagcaatagtaggaaaagatgttcaagcattagcaaaattagcaggaataagcataccaagcgatgcggtaatattactttcagagcagacagatgtgagtccaaagaacccttatgcaaaggaaaaattagctccagtacttgcattctatacagtagaagactggcatgaagcatgtgaaaaatccttagcacttcttcataaccaaggaagtggacatacattaataattcactcacagaatgaagaaatcataagagaattcgcattgaagaaaccagtatcaagaatacttgtaaattcacctggatcacttggaggaataggtggagctacaaatcttgtaccatcacttacattaggctgtggagcagtaggtggaagtgcaacttcagataacgtaggaccagaaaacttattcaacataagaaaagtagcttatggaactacgacagtagaagaaataagagaagcttttggtgtaggagcagcttcatcaagtgcaccagcagaaccagaagataatgaagatgtacaggctatagtaaaagctataatggctaaattaaatctttaa

SEQ ID NO: 55 - protein, 491 aa, Clostridium kluyveri
MEIMDKDLQSIQEVRTLIAKAKKAQAEFKNFSQEAVNKVIEKIAKATEVEAVKLAKLAYEDTGYGKWEDKVIKNKFSSIVVYNYIKDLKTVGILKEDKEKKLIDIAVPLGVIAGLIPSTNPTSTAIFKVLIALKAGNAIVFSPHPTAVRSITETVKIMQKAAVEAGAPDGLIQCMSILTVEGTAELMKNKDTALILATGGEGMVRAAYSSGTPAIGVGPGNGPCFIERTADIPTAVRKVIGSDTFDNGVICASEQSIIAETVKKAEIIEEFKRQKGYFLNAEESEKVGKILLRANGTPNPAIVGKDVQALAKLAGISIPSDAVILLSEQTDVSPKNPYAKEKLAPVLAFYTVEDWHEACEKSLALLHNQGSGHTLIIHSQNEEIIREFALKKPVSRILVNSPGSLGGIGGATNLVPSLTLGCGAVGGSATSDNVGPENLFNIRKVAYGTTTVEEIREAFGVGAASSSAPAEPEDNEDVQAIVKAIMAKLNL

SEQ ID NO: 56 - DNA, 12188 bp, Artificial Sequence
  Synthetic plasmid.
cgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttgttacaaccaattaaccaattctgattatacacggggttctgcaggaataaccgagatgccgcgaaacgagtcagtcaacttcgggcgccattcggtacgtgcacgaaggacttcgctgccaccctccaattgaaggaggtgatcgcataccaacccagcttcggagctcccaccgctcacagtggttaagctacgtaacacgctgtcacgggtacactcacgacgatactcaagcgtgaaacttgaaatgtggtgagactcgaagatcgagtcgggcacggtttcgaatacccaagccacgtattttaaattattcacatgctggttgacatccaaatcgttccagcgcggcgttaaacctccttggatatagtctgcggttgaatcattaagtttttgcaacttcttgatttcgtcatctttcactgcaacattatcgataaatgccggtccgatttcaccacggacttcatccgggatcgtactcaaacgacgtgtacgtgtgttcattaagacggaaagagaggtacaacgcgtcaaaatctcgcctgttttacaatcgcggaccaggaaatcacgacgcatcccgttgttgccggaagccccgatccaacactcgacttcgacggtgtccccccatgttggataacgttccaccgctacgtgtgtgcggcgaacaacccacattaaatcacgtttagacatctcaagagttgtaccgaacccgtcacctaaaataccaacacttttggcgtgattcaaagtggcctcttgcatgtggttcataactgccaaaatggatgtcgagcggtccggccccacctcataggaacggatagcaaaagtacgacgaaatacaagaccgtgaagcccaaagtggtcatctaataattggggcagctttggcttaggtttccactcaagcatttaatatatacctctttttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaaggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacaggtgagctgataccgctcgccgcatgcacatgcagtcatgtcgtgctaatgtgtaaaacatgtacatgcagattgctgggggtgcagggggcggagccaccctgtccatgcggggtgtggggcttgccccgccggtacagacagtgagcaccggggcacctagtcgcggataccccccctaggtatcggacacgtaaccctcccatgtcgatgcaaatctttaacattgagtacgggtaagctggcacgcatagccaagctaggcggccaccaaacaccactaaaaattaatagtccctagacaagacaaacccccgtgcgagctaccaactcatatgcacgggggccacataacccgaaggggtttcaattgacaaccatagcactagctaagacaacgggcacaacacccgcacaaactcgcactgcgcaaccccgcacaacatcgggtctaggtaacactgaaatagaagtgaacacctctaaggaaccgcaggtcaatgagggttctaaggtcactcgcgctagggcgtggcgtaggcaaaacgtcatgtacaagatcaccaatagtaaggctctggcggggtgccataggtggcgcagggacgaagctgttgcggtgtcctggtcgtctaacggtgcttcgcagtttgagggtctgcaaaactctcactctcgctgggggtcacctctggctgaattggaagtcatgggcgaacgccgcattgagctggctattgctactaagaatcacttggcggcgggtggcgcgctcatgatgtttgtgggcactgttcgacacaaccgctcacagtcatttgcgcaggttgaagcgggtattaagactgcgtactcttcgatggtgaaaacatctcagtggaagaaagaacgtgcacggtacggggtggagcacacctatagtgactatgaggtcacagactcttgggcgaacggttggcacttgcaccgcaacatgctgttgttcttggatcgtccactgtctgacgatgaactcaaggcgtttgaggattccatgttttcccgctggtctgctggtgtggttaaggccggtatggacgcgccactgcgtgagcacggggtcaaacttgatcaggtgtctacctggggtggagacgctgcgaaaatggcaacctacctcgctaagggcatgtctcaggaactgactggctccgctactaaaaccgcgtctaaggggtcgtacacgccgtttcagatgttggatatgttggccgatcaaagcgacgccggcgaggatatggacgctgttttggtggctcggtggcgtgagtatgaggttggttctaaaaacctgcgttcgtcctggtcacgtggggctaagcgtgctttgggcattgattacatagacgctgatgtacgtcgtgaaatggaagaagaactgtacaagctcgccggtctggaagcaccggaacgggtcgaatcaacccgcgttgctgttgctttggtgaagcccgatgattggaaactgattcagtctgatttcgcggttaggcagtacgttctagattgcgtggataaggctaaggacgtggccgctgcgcaacgtgtcgctaatgaggtgctggcaagtctgggtgtggattccaccccgtgcatgatcgttatggatgatgtggacttggacgcggttctgcctactcatggggacgctactaagcgtgatctgaatgcggcggtgttcgcgggtaatgagcagactattcttcgcacccactaaaagcggcataaaccccgttcgatattttgtgcgatgaatttatggtcaatgtcgcgggggcaaactatgatgggtcttgttgttgcagccgaacgacctagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggcgacctcgtcggaggttgtatgtccggtgttccgtgacgtcatcgggcattcatcattcatagaatgtgttacggaggaaacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcaacaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtggaaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggccagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcaggatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctcccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcgga

SEQ ID NO: 57 - DNA, 13886 bp, Artificial Sequence
  Synthetic plasmid.
gtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatggagagcaggacctccgctgtgactcttcttttttttcttttattctcactacatacattttagttattcgccaacatgggtgaactcaaggaaatcttgaaacagaggtatcatgagttgcttgactggaatgtcaaagcccctcatgtccctctcagtcaacgactgaagcattttacatggtcttggtttgcatgtactatggcaactggtggtgttggtttgattattggttctttcccctttcgattttatggtcttaatacaattggcaaaattgtttatattcttcaaatctttttgttttctctctttggatcatgcatgctttttcgctttattaaatatccttcaactatcaaggattcctggaaccatcatttggaaaagcttttcattgctacttgtcttctttcaatatccacgttcatcgacatgcttgccatatacgcctatcctgataccggcgagtggatggtgtgggtcattcgaatcctttattacatttacgttgcagtatcctttatatactgcgtaatggctttttttacaattttcaacaaccatgtatataccattgaaaccgcatctcctgcttggattcttcctattttccctcctatgatttgtggtgtcattgctggcgccgtcaattctacacaacccgctcatcaattaaaaaatatggttatctttggtatcctctttcaaggacttggtttttgggtttatcttttactgtttgccgtcaatgtcttacggttttttactgtaggcctggcaaaaccccaagatcgacctggtatgtttatgtttgtcggtccaccagctttctcaggtttggccttaattaatattgcgcgtggtgctatgggcagtcgcccttatatttttgttggcgccaactcatccgagtatcttggttttgtttctacctttatggctatttttatttggggtcttgctgcttggtgttactgtctcgccatggttagctttttagcgggctttttcactcgagcccctctcaagtttgcttgtggatggtttgcattcattttccccaacgtgggttttgttaattgtaccattgagataggtaaaatgatagattccaaagctttccaaatgtttggacatatcattggggtcattctttgtattcagtggatcctcctaatgtatttaatggtccgtgcgtttctcgtcaatgatctttgctatcctggcaaagacgaagatgcccatcctccaccaaaaccaaatacaggtgtccttaaccctaccttcccacctgaaaaagcacctgcatctttggaaaaagtcgatacacatgtcacatctactggtggtgaatcggatcctcctagtagtgaacatgaaagcgtttaaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagctttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacaatggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattgccagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaagtaaagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaa

SEQ ID NO: 58 - DNA, 1047 bp, Methylococcus capsulatus (Bath)
atgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctga

SEQ ID NO: 59 - protein, 348 aa, Methylococcus capsulatus (Bath)
MQRVHTITAVTEDGESLRFECRSDEDVITAALRQNIFLMSSCREGGCATCKALCSEGDYDLKGCSVQALPPEEEEEGLVLLCRTYPKTDLEIELPYTHCRISFGEVGSFEAEVVGLNWVSSNTVQFLLQKRPDECGNRGVKFEPGQFMDLTIPGTDVSRSYSPANLPNPEGRLEFLIRVLPEGRFSDYLRNDARVGQVLSVKGPLGVFGLKERGMAPRYFVAGGTGLAPVVSMVRQMQEWTAPNETRIYFGVNTEPELFYIDELKSLERSMRNLTVKACVWHPSGDWEGEQGSPIDALREDLESSDANPDIYLCGPPGMIDAACELVRSRGIPGEQVFFEKFLPSGAA

SEQ ID NO: 60 - DNA, 312 bp, Methylococcus capsulatus (Bath)
atggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattga

SEQ ID NO: 61 - protein, 103 aa, Methylococcus capsulatus (Bath)
MVESAFQPFSGDADEWFEEPRPQAGFFPSADWHLLKRDETYAAYAKDLDFMWRWVIVREERIVQEGCSISLESSIRAVTHVLNYFGMTEQRAPAEDRTGGVQH

SEQ ID NO: 62 - DNA, 1680 bp, Methylococcus capsulatus (Bath)
atggcaaaggaagtggtttacagggggagtgcgcggcagcgcatgatgcaaggcatcgagatactcgcgcgggcggcgataccgacgctgggagccaccggccccagcgtcatgatccagcaccgcgccgatggcctgccccccatttcgacgcgggacggcgtcacggtggctaactccatcgtactcaaggaccgtgtcgcgaatctcggtgcccggctgctgcgggacgtcgccggcaccatgtcccgcgaagcaggggatggcaccaccaccgccatcgtgctggcccgccatatcgcccgggagatgttcaagagcctcgccgtcggtgccgatcccatcgctctcaagcgtggtatcgaccgtgccgtcgcccgcgtgagcgaggacatcggggctcgggcctggcgcggcgacaaggaatcggtcatcctgggggtggccgcggtggcgaccaagggcgagccgggcgtgggccggctgctgctggaggcgctggacgcggtcggcgtccatggcgccgtgtcgatcgaactggggcagcggcgcgaggacctgctcgacgtggtcgacgggtatcgttgggaaaaaggttatctgtcgccctattttgtgaccgatcgggctcgcgagctggccgaactcgaagacgtctacctcttgatgaccgatcgggaggtggtcgatttcatcgatttggtacccctgctggaggcggtgaccgaggctggtggcagcctcctgatcgccgccgaccgtgtccacgagaaggcactggccggccttttgctcaatcacgttcgcggcgtcttcaaggccgtcgcggtcaccgcgcccgggttcggcgacaagcggccgaaccgccttttggatctggcggcgttgaccggtgggcgggcggtcctggaagcccagggcgaccgattggaccgggtcacgctggccgacctggggcgggtgcggcgggcggtcgtcagcgctgacgacaccgcgctgctcggcataccgggcaccgaagcctcccgggcccgcttggagggtttgcgcctggaagcggagcagtaccgggcgctcaagcccggtcagggatcggcgacggggcgcttgcacgagctcgaggaaatcgaggcccggatcgtcggtctgagcggcaagtccgcggtctaccgcgtgggcggcgtgaccgacgtggagatgaaggagcggatggtacggatcgaaaatgcctaccgctcggtggtgtctgcactggaggagggggtgttgcccggcggcggtgtcgggtttctgggcagcatgcccgttttggccgagctggaagcgcgcgatgccgacgaagcacgcggcatcggcatcgtccgttccgcgctgacggagcccctccggatcatcggagaaaattcgggactgtcaggggaggccgtcgtcgccaaggtcatggatcacgccaatcccggttggggttacgatcaggaaagcggaagtttctgcgacctccacgccaggggcatttgggatgccgccaaggtgctcaggctggccctggaaaaagccgcgtcggtggccggcacgtttctcaccaccgaagccgtggtactggagattccggacactgacgctttcgccggtttcagtgcggagtgggccgccgcgacccgggaggatccgcgggtctga

SEQ ID NO: 63 - protein, 559 aa, Methylococcus capsulatus (Bath)
MAKEVVYRGSARQRMMQGIEILARAAIPTLGATGPSVMIQHRADGLPPISTRDGVTVANSIVLKDRVANLGARLLRDVAGTMSREAGDGTTTAIVLARHIAREMFKSLAVGADPIALKRGIDRAVARVSEDIGARAWRGDKESVILGVAAVATKGEPGVGRLLLEALDAVGVHGAVSIELGQRREDLLDVVDGYRWEKGYLSPYFVTDRARELAELEDVYLLMTDREVVDFIDLVPLLEAVTEAGGSLLIAADRVHEKALAGLLLNHVRGVFKAVAVTAPGFGDKRPNRLLDLAALTGGRAVLEAQGDRLDRVTLADLGRVRRAVVSADDTALLGIPGTEASRARLEGLRLEAEQYRALKPGQGSATGRLHELEEIEARIVGLSGKSAVYRVGGVTDVEMKERMVRIENAYRSVVSALEEGVLPGGGVGFLGSMPVLAELEARDADEARGIGIVRSALTEPLRIIGENSGLSGEAVVAKVMDHANPGWGYDQESGSFCDLHARGIWDAAKVLRLALEKAASVAGTFLTTEAVVLEIPDTDAFAGFSAEWAAATREDPRV

SEQ ID NO: 64 - DNA, 294 bp, Escherichia coli
atgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaa

SEQ ID NO: 65 - protein, 97 aa, Escherichia coli [sequence omitted]

SEQ ID NO: 66 - DNA, 1647 bp, Escherichia coli
atggcagctaaagacgtaaaattcggtaacgacgctcgtgtgaaaatgctgcgcggcgtaaacgtactggcagatgcagtgaaagttaccctcggtccaaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcaaacgacgctgcaggcgacggtaccaccactgcaaccgtactggctcaggctatcatcactgaaggtctgaaagctgttgctgcgggcatgaacccgatggacctgaaacgtggtatcgacaaagcggttaccgctgcagttgaagaactgaaagcgctgtccgtaccatgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagctgttgccaaagcaggcaaaccgctgctgatcatcgctgaagatgtagaaggcgaagcgctggcaactctggttgttaacaccatgcgtggcatcgtgaaagtcgctgcggttaaagcaccgggcttcggcgatcgtcgtaaagctatgctgcaggatatcgcaaccctgactggcggtaccgtgatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtgggtgctgctaccgaagttgaaatgaaagagaaaaaagcacgcgttgaagatgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtattgaactgcggcgaagaaccgtctgttgttgctaacaccgttaaaggcggcgacggcaactacggttacaacgcagcaaccgaagaatacggcaacatgatcgacatgggtatcctggatccaaccaaagtaactcgttctgctctgcagtacgcagcttctgtggctggcctgatgatcaccaccgaatgcatggttaccgacctgccgaaaaacgatgcagctgacttaggcgctgctggcggtatgggcggcatgggtggcatgggcggcatgatgtaa

SEQ ID NO: 67 - protein, 548 aa, Escherichia coli
MAAKDVKFGNDARVKMLRGVNVLADAVKVTLGPKGRNVVLDKSFGAPTITKDGVSVAREIELEDKFENMGAQMVKEVASKANDAAGDGTTTATVLAQAIITEGLKAVAAGMNPMDLKRGIDKAVTAAVEELKALSVPCSDSKAIAQVGTISANSDETVGKLIAEAMDKVGKEGVITVEDGTGLQDELDVVEGMQFDRGYLSPYFINKPETGAVELESPFILLADKKISNIREMLPVLEAVAKAGKPLLIIAEDVEGEALATLVVNTMRGIVKVAAVKAPGFGDRRKAMLQDIATLTGGTVISEEIGMELEKATLEDLGQAKRVVINKDTTTIIDGVGEEAAIQGRVAQIRQQIEEATSDYDREKLQERVAKLAGGVAVIKVGAATEVEMKEKKARVEDALHATRAAVEEGVVAGGGVALIRVASKLADLRGQNEDQNVGIKVALRAMEAPLRQIVLNCGEEPSVVANTVKGGDGNYGYNAATEEYGNMIDMGILDPTKVTRSALQYAASVAGLMITTECMVTDLPKNDAADLGAAGGMGGMGGMGGMM

SEQ ID NO: 68 - DNA, 291 bp, Methylococcus capsulatus (Bath)
gtgaaaatccgcccgttacatgaccgtgtcatcatcaaacgcttggaagaagagcgtacctcggcgggcgggattgtcattccagatagcgcagctgaaaaaccgatgcgtggtgaaatcctggcagtgggcaatggaaaagtgcttgataatggagaggtacgtgctttacaggtgaaagtgggtgataaagtgctctttgggaaatacgcgggtacggaggttaaagtagatggggaagatgttgttgtcatgcgtgaagatgacattctggctgtgttagaatcttaa

SEQ ID NO: 69 - protein, 96 aa, Methylococcus capsulatus (Bath)
MKIRPLHDRVIIKRLEEERTSAGGIVIPDSAAEKPMRGEILAVGNGKVLDNGEVRALQVKVGDKVLFGKYAGTEVKVDGEDVVVMREDDILAVLES

SEQ ID NO: 70 - DNA, 60 bp, Artificial Sequence
  Synthetic primer.
tgagtttaaacgcggccgcaatttgaacgcacccataacagatacggactttctcaaagg

SEQ ID NO: 71 - DNA, 30 bp, Artificial Sequence
  Synthetic primer.
cgtgaaaggcgagatcaccaaggtagtcgg

SEQ ID NO: 72 - DNA, 2244 bp, Artificial Sequence
  Synthetic plasmid.
cctcctgccagagttcacataaacagacgcttttccggtgcatctgtgggagccgtgaggctcaaccatgaatctgacagtacgggcgaaacccgacaggacttaaagatccccaccgtttccggcgggtcgctccctcttgcgctctcctgttccgaccctgccgtttaccggatacctgttccgcctttctcccttacgggaagtgtggcgctttctcatagctcacacactggtatctcggctcggtgtaggtcgttcgctccaagctgggctgtaagcaagaactccccgttcagcccgactgctgcgccttatccggtaactgttcacttgagtccaacccggaaaagcacggtaaaacgccactggcagcagccattggtaactgggagttcgcagaggatttgtttagctaaacacgcggttgctcttgaagtgtgcgccaaagtccggctacactggaaggacagatttggttgctgtgctctgcgaaagccagttaccacggttaagcagttccccaactgacttaaccttcgatcaaaccacctccccaggtggttttttcgtttacagggcaaaagattacgcgcagaaaaaaaggatctcaagaagatcctttgatcttttctactgaaccgctctagatttcagtgcaatttatctcttcaaatgtagcacctgaagtcagccccatacgatataagttgtaattctcatgttagtcatgccccgcgcccaccggaaggagctgactgggttgaaggctctcaagggcatcggtcgagatcccggtgcctaatgagtgagctaacttttgacagctagctcagtcctagggactatgctagcaccagcctcgagggaaaccacgtaagctccggcgtttaaacgcggccgcaatttgaacgccagcacatggactctcgagtctactagcgcagcttaattaacctaggctgctgccaccgctgagcaataactagcataaccccttggggcctctaaacgggtcttgaggggttttttgctgaaacctcaggcatttgagaagcacacggtcacactgcttccggtagtcaataaaccggtaaaccagcaatagacataagcggctatttaacgaccctgccctgaaccgacgaccgggtcatcgtggccggatcttgcggcccctcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaatagctagctcactcggtcgctacgctccgggcgtgagactgcggcgggcgctgcggacacatacaaagttacccacagattccgtggataagcaggggactaacatgtgaggcaaaacagcagggccgcgccggtggcgtttttccataggctccgc

SEQ ID NO: 73 - DNA, 7100 bp, Artificial Sequence
  Synthetic plasmid.
tcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgaaattccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatttcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcaattgaccaacaaggaggatattatggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttacaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaaaagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaactcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttcggtccgttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgtttcccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttccttaggactgagcgtcaaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatataaggtgcactgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgcagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagca

SEQ ID NO: 74 - DNA, 57 bp, Artificial Sequence
  Synthetic primer.
catttgacaggcacattatgcaccgcttatgtctattgctggtttaccggtttattg

SEQ ID NO: 75 - DNA, 60 bp, Artificial Sequence
  Synthetic primer.
gggaccacgttgttacaaccaattaaccaattctgactatttaacgaccctgccctgaac

SEQ ID NO: 76 - DNA, 32 bp, Artificial Sequence
  Synthetic primer.
tgcataatgtgcctgtcaaatggacgaagcag

SEQ ID NO: 77 - DNA, 34 bp, Artificial Sequence
  Synthetic primer.
gttgtaacaacgtggtcccagtattccttgagct

SEQ ID NO: 78 - DNA, 46 bp, Artificial Sequence
  Synthetic primer.
tgctcgatgagtttttctaaccggaaggagctgactgggttgaagg

SEQ ID NO: 79 - DNA, 26 bp, Artificial Sequence
  Synthetic primer.
ggagcgtagcgaccgagtgagctagc

SEQ ID NO: 80 - DNA, 47 bp, Artificial Sequence
  Synthetic primer.
gctagctcactcggtcgctacgctccgctaggtcgttcggctgcaac

SEQ ID NO: 81 - DNA, 54 bp, Artificial Sequence
  Synthetic primer.
acccagtcagctccttccggttagaaaaactcatcgagcatcaaatgaaactgc

SEQ ID NO: 82 - DNA, 4716 bp, Artificial Sequence
  Synthetic plasmid.
ccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagacc

SEQ ID NO: 83 - DNA, 9557 bp, Artificial Sequence
  Synthetic plasmid.
acagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgctcgagcagatctagggagggcatcattgaggtttccacaaaaggaagaaacatggatccagagacatcaacagagaggaaagcgggtagtgaagccgaagccacaacacagcccgatttggaagggagttcacaatcaaggtgagtccagccattttttttcttttttttttttttattcaggtgaacccacctaactatttttaactgggatccagtgagctcgctgggtgaaagccaaccatcttttgtttcggggaaccgtgctcgccccgtaaagttaatttttttttcccgcgcagctttaatctttcggcagagaaggcgttttcatcgtagcgtgggaacagaataatcagttcatgtgctatacaggcacatggcagcagtcactattttgctttttaaccttaaagtcgttcatcaatcattaactgaccaatcagattttttgcatttgccacttatctaaaaatacttttgtatctcgcagatacgttcagtggtttccaggacaacacccaaaaaaaggtatcaatgccactaggcagtcggttttatttttggtcacccacgcaaagaagcacccacctcttttaggttttaagttgtgggaacagtaacaccgcctagagcttcaggaaaaaccagtacctgtgaccgcaattcaccatgatgcagaatgttaatttaaacgagtgccaaatcaagatttcaacagacaaatcaatcgatccatagttacccattccagccttttcgtcgtcgagcctgcttcattcctgcctcaggtgcataactttgcatgaaaagtccagattagggcagattttgagtttaaaataggaaatataaacaaatataccgcgaaaaaggtttgtttatagcttttcgcctggtgccgtacggtataaatacatactctcctcccccccctggttctctttttcttttgttacttacattttaccgttccgtcactcgcttcactcaacaacaaaaatgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaagtaaagacatgactgttcctcagttcaagttgggcacttacgagaagaccggtcttgctagattctaatcaagaggatgtcagaatgccatttgcctgagagatgcaggcttcatttttgattacttttttatttgtaacctatatagtataggattttttttgtcattttgtttcttctcgtacgagcttgctcctgatcagcctatctcgcagctgatgaatatcttgtggtaggggtttgggaaaatcattcgagtttgatgtttttcttggtatttcccactcctcttcagagtacagaagattaagtgagagcggccgcccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagacccc

SEQ ID NO: 84 - DNA, 6428 bp, Artificial Sequence
  Synthetic plasmid.
tcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacaatggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgatt

SEQ ID NO: 85 - DNA, 7311 bp, Artificial Sequence
  Synthetic plasmid.
tcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatggagagcaggacctccgctgtgactcttcttttttttcttttattctcactacatacattttagttattcgccaacatgggtgaactcaaggaaatcttgaaacagaggtatcatgagttgcttgactggaatgtcaaagcccctcatgtccctctcagtcaacgactgaagcattttacatggtcttggtttgcatgtactatggcaactggtggtgttggtttgattattggttctttcccctttcgattttatggtcttaatacaattggcaaaattgtttatattcttcaaatctttttgttttctctctttggatcatgcatgctttttcgctttattaaatatccttcaactatcaaggattcctggaaccatcatttggaaaagcttttcattgctacttgtcttctttcaatatccacgttcatcgacatgcttgccatatacgcctatcctgataccggcgagtggatggtgtgggtcattcgaatcctttattacatttacgttgcagtatcctttatatactgcgtaatggctttttttacaattttcaacaaccatgtatataccattgaaaccgcatctcctgcttggattcttcctattttccctcctatgatttgtggtgtcattgctggcgccgtcaattctacacaacccgctcatcaattaaaaaatatggttatctttggtatcctctttcaaggacttggtttttgggtttatcttttactgtttgccgtcaatgtcttacggttttttactgtaggcctggcaaaaccccaagatcgacctggtatgtttatgtttgtcggtccaccagctttctcaggtttggccttaattaatattgcgcgtggtgctatgggcagtcgcccttatatttttgttggcgccaactcatccgagtatcttggttttgtttctacctttatggctatttttatttggggtcttgctgcttggtgttactgtctcgccatggttagctttttagcgggctttttcactcgagcccctctcaagtttgcttgtggatggtttgcattcattttccccaacgtgggttttgttaattgtaccattgagataggtaaaatgatagattccaaagctttccaaatgtttggacatatcattggggtcattctttgtattcagtggatcctcctaatgtatttaatggtccgtgcgtttctcgtcaatgatctttgctatcctggcaaagacgaagatgcccatcctccaccaaaaccaaatacaggtgtccttaaccctaccttcccacctgaaaaagcacctgcatctttggaaaaagtcgatacacatgtcacatctactggtggtgaatcggatcctcctagtagtgaacatgaaagcgtttaaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagct

SEQ ID NO: 86 - DNA, 9033 bp, Artificial Sequence
  Synthetic plasmid.
tcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccaagaagttgattgagactttcaacgagattgctgaagacaaggaacaattcgagaagttttacagtgctttctccaagaacttgaagttgggtgtccatgaagacagccaaaacagatccgcattggccaagttgctgagatttaactccaccaagtctactgaggagctaacctcattctctgactacgtcaccagaatgccagagcaccagaagaacatctacttcattaccggtgagtctgtcaaggctcttgagaaatctccattcttggatgctttgaaggagaagaactttgaggtcctattgctgaccgatcctattgatgagtacgctatgactcaattgaaagagattgaggacaagaaattggttgacatcactaaagactttgagctggaagagtctgaggaggagaagaaggctagagaggaagaggttaaagatttcgagcctttgactaaagccctgaaagagattttgggtgacaaggttgagaaggttgtagtttcctacaagctggttgactctcctgctgctattagaacttcccaattcggctggtctgctaacatggaaagaattatgaaggctcaagctctgagagacaccaacaccatgtcctcgtacatggcttcaaagaagatcttcgagatctctccaaagtcgccaatcattaaggctttgagaaagaaggttgaggctaccggtacagaagagaccccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgggtctcacagatgacagagttgtcaagaacttgaccactttgttgttcgacacagctttgttgacttccggtttcactttggatgagccaacttctttcgctgccagaatcaacggtttgatctccattggtttgaacatcgatgaggaggaagagaaagagccagaacaggctactgaagctccaagtgaagaagctgttgctgagtctgccatggaggaggttgactagttgaatttaggtatatatagtgactgtgatatttagctaatgaaatctaattggatatttagaatgcctcatctcgtagcctatcaattactattaggccatctcttatgggcccttctttgaaattgcattcaaggggggatgggactattttgaatttgaagtttggactctgtgagctgtttggccaattgaagtcatccacttgtacacagggattcaccagtagtttagaacaattctctatcgttattctcttgtcgtctttggcaatacaagcgtcgatgactgagttggtgactttatgaagtctaagttgatatgagtttgaaattatgaaacagttttttacactggacatgtagatagggcccttgatgtttaggaagaggatacagtttgagatgttggagatgtgtgtggagggagcgaccacttttaaaaccacatgatccagacgttgctcagttatcgaagtttcggaaacaacgccagatctgtttagcttgggtatttgacaggttggggagcaaataagtgatgatgtcccatgaaagtagaaaatggctagtagaaggcaaaaatttgaaattcttagagtcaaatagttagactccaagttctaatccacatttggtcagtttcatagcatccagagcttttgccactggtgaacatatctacccattgcgatgcaacaagtcactgaaagcctaaaacggagattcccctatcttacagcctcgttcaaaaaaactgctaccgtttatctgctatggccgatgtgaggatgcgctcatgcccaagagtccaactttatcaaaaacttgacccgtcatacaggctctagatcaagaagcaaacttaatctcagcatctggttacgtaactctggcaaccagtaacacgcttaaggtttggaacaacactaaactaccttgcggtactaccattgacactacacatccttaattccaatcctgtctggcctccttcaccttttaaccatcttgcccattccaactcgtgtcagattgcgtatcaagtgaaaaaaaaaaattttaaaatctttaacccaatcaggtaataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttctttttcacgaaaatttttttttacacaagattttcagcagatataaaatggagagcaggacctccgctgtgactcttcttttttttcttttattctcactacatacattttagttattcgccaacatgggtgaactcaaggaaatcttgaaacagaggtatcatgagttgcttgactggaatgtcaaagcccctcatgtccctctcagtcaacgactgaagcattttacatggtcttggtttgcatgtactatggcaactggtggtgttggtttgattattggttctttcccctttcgattttatggtcttaatacaattggcaaaattgtttatattcttcaaatctttttgttttctctctttggatcatgcatgctttttcgctttattaaatatccttcaactatcaaggattcctggaaccatcatttggaaaagcttttcattgctacttgtcttctttcaatatccacgttcatcgacatgcttgccatatacgcctatcctgataccggcgagtggatggtgtgggtcattcgaatcctttattacatttacgttgcagtatcctttatatactgcgtaatggctttttttacaattttcaacaaccatgtatataccattgaaaccgcatctcctgcttggattcttcctattttccctcctatgatttgtggtgtcattgctggcgccgtcaattctacacaacccgctcatcaattaaaaaatatggttatctttggtatcctctttcaaggacttggtttttgggtttatcttttactgtttgccgtcaatgtcttacggttttttactgtaggcctggcaaaaccccaagatcgacctggtatgtttatgtttgtcggtccaccagctttctcaggtttggccttaattaatattgcgcgtggtgctatgggcagtcgcccttatatttttgttggcgccaactcatccgagtatcttggttttgtttctacctttatggctatttttatttggggtcttgctgcttggtgttactgtctcgccatggttagctttttagcgggctttttcactcgagcccctctcaagtttgcttgtggatggtttgcattcattttccccaacgtgggttttgttaattgtaccattgagataggtaaaatgatagattccaaagctttccaaatgtttggacatatcattggggtcattctttgtattcagtggatcctcctaatgtatttaatggtccgtgcgtttctcgtcaatgatctttgctatcctggcaaagacgaagatgcccatcctccaccaaaaccaaatacaggtgtccttaaccctaccttcccacctgaaaaagcacctgcatctttggaaaaagtcgatacacatgtcacatctactggtggtgaatcggatcctcctagtagtgaacatgaaagcgtttaaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagctttttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacacaatggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttaagtatctccagtcgtttagattgttagatattttctttgtgtattcgtttcagtctgatgtttatgctacaaacgtcatctggactttaatccaataaggatattcttcaacttaatagtatcttaataatattttttttcttttgatttcttcgtaaggtgttttgttgcactcatgatctacgacttttgttcgtgactgattgcggccgc

SEQ ID NO: 87 - DNA, 1587 bp, Artificial Sequence
  Synthetic plasmid
atggcaattagtgcggcgacgaaagcggctactgatgcacttgcggccaaccgcgcgccaacttcagtgaatgctcaagaagtccaccgttggctccaatcgtttaactgggattttaaaaacaaccgtaccaaatacgccactaagtataaaatggcaaacgagacaaaagagcaattcaaattaatcgcgaaggagtacgcacgtatggaaagcgtgaaagacgagcgtcagttcggaagccttcaagatgcgttaacccgcctgcagagcgctgtgcgtgtgcatccgaaatggaatgaaactatgaaagtagtgtccaacttcctcgaagtgggtgagtataacgcaattgccgcaactggcatgctttgggactccgcgcaagcggctgaacaaaagaacggttatctcgcacaggttttggatgaaatccgccacacccatcaatgcgcgtatgttaattattatttcgcaaagaacggccaggacccggcagggcacaatgatgcgcgtcgtacacgcaccttggggccgctgtggaaaggtatgaaacgtgttttctcagatggcttcatctccggcgacgcggtcgaatgctcacttaatctgcaactggtgggcgaagcctgctttactaatccgctgatcgttgccgttaccgaatgggctgccgcgaacggtgatgaaatcaccccgaccgtgttcctgtcgatcgagacagatgaacttcgtcatatggcaaacgggtatcagaccgttgtttctattgcaaatgatccggccagcgctaaatatatgaatactgacttaaacaatgcattctggacacagcagaaatattttacgccggtccttggcatgctgttcgaatacggttcaaagtttaaggttgaaccgtgggtgaaaacctggaatcgttgggtctatgaggattggggcggaatttggatcggacgcctgggcaaatatggcgtcgaaagtcctcgctccctgaaggatgccaaacaggatgcgtactgggcgcaccacgacctgtaccttctggcatatgctctgtggccgaccggtttcttccgcttagcgttgcctgatcaagaagagatggaatggtacgaagcgaattacccaggttggtacgaccattacggtaaaatctatgaagaatggcgtgcacgcggttgcgaagatccaagcagtggtttcattccgctgcaatggtttattgaaaacaaccaccccatttatatcgatcgcacgtcacaggtccccttttgtccgagtcttgcgaaacacgcgacgaccttgcgtgtgcacgaatataacggtcagctccacacgcatgcggaccaatggggtgaacgcatgtggctggcggaaccggaacgctatgagtgtcaaaatatgtttgaacagtatgagggccgtgaattaagcgaggttatcgcagaactgtggggtgtgcgttcagacggcaaaacacttatcgcgcaaccgcacgtccgcggtgataaactctggaccctggatgatattaaacgtgttggatgcgttttttcaaaccctgcgaaagccctgaaagcgtaa

SEQ ID NO: 88 - protein, 528 aa, Methylocaldum sp.175
MAISAATKAATDALAANRAPTSVNAQEVHRWLQSFNWDFKNNRTKYATKYKMANETKEQFKLIAKEYARMESVKDERQFGSLQDALTRLQSAVRVHPKWNETMKVVSNFLEVGEYNAIAATGMLWDSAQAAEQKNGYLAQVLDEIRHTHQCAYVNYYFAKNGQDPAGHNDARRTRTLGPLWKGMKRVFSDGFISGDAVECSLNLQLVGEACFTNPLIVAVTEWAAANGDEITPTVFLSIETDELRHMANGYQTVVSIANDPASAKYMNTDLNNAFWTQQKYFTPVLGMLFEYGSKFKVEPWVKTWNRWVYEDWGGIWIGRLGKYGVESPRSLKDAKQDAYWAHHDLYLLAYALWPTGFFRLALPDQEEMEWYEANYPGWYDHYGKIYEEWRARGCEDPSSGFIPLQWFIENNHPIYIDRTSQVPFCPSLAKHATTLRVHEYNGQLHTHADQWGERMWLAEPERYECQNMFEQYEGRELSEVIAELWGVRSDGKTLIAQPHVRGDKLWTLDDIKRVGCVFSNPAKALKA

SEQ ID NO: 89 - DNA, 1170 bp, Artificial Sequence
  Synthetic plasmid
atgccgctgctggacgaaaaacgtcgtggcttgaccgacccggaatgggcgagcgttatcctgaacgccctgccggcagagcctttggataaacaaaacaagatgggctactttgttaccccacgctggaagcgtttgacggaatatgaagctctcaccgtttatgctcagcctaacgcggattggattgcgggtggtttggattggggagactggactcagaaatttcacggcggccgtccgtcgtggggcaacgaaaccacggaactgcgcacggtagattggtttaaacaccgtgatccactccgccgctggcatgccccgtatgtgaaagataaagcggaagagtggcgttacactgatcgctttctgcaaggctatagcgcggacggtcagattcgtaccatggaccctttctggcgcgatgaattcattaacaaatactggggtgcgttcctgtttaacgaatacggtcagttcaacgcccattcaggaggcgcacgtgaagcgctgtcggacaccatccgtgtatcgctgacgttttggggttttgataaaatcgatctggcccagatgatccagctggaacgtggcttcttagctaaaattgtaccgggctttgatgaatctacggcggtgccgaaagcagaatggacccagggctctgtctataaaagtgctcgtggcacgatcgaggcattgtggcaagacgtcttcgactggaacgaaaacgcgttttcagtacatgcagtgtacgatagcctgtttggtcaatttgtgcgtcgcgagttctttcagcgcttagcccctaaatttggcgataatctcacacccttttttatcaaccagagccagacctattacggcattgctaaacagggcgtgcaggatctctattacacctgtttagcgaatgatcctgaattcggtgactacaaccgcacagtcctccgcaattggaccgctaaatggctggaagggacggtgaatgcgctgcgtgatttcatgggtatttttgcgaagctgccgaccggaaccacacacaaggccgaaatccaggccagcttagaacgcgtgatcgacgattggaccgcggatcatgccagccgtattgatttcaaagtcgatcgtgatgcgattgttcgtcatgtcatgagcggtctgatttga

SEQ ID NO: 90 - protein, 389 aa, Methylocaldum sp.175
MPLLDEKRRGLTDPEWASVILNALPAEPLDKQNKMGYFVTPRWKRLTEYEALTVYAQPNADWIAGGLDWGDWTQKFHGGRPSWGNETTELRTVDWFKHRDPLRRWHAPYVKDKAEEWRYTDRFLQGYSADGQIRTMDPFWRDEFINKYWGAFLFNEYGQFNAHSGGAREALSDTIRVSLTFWGFDKIDLAQMIQLERGFLAKIVPGFDESTAVPKAEWTQGSVYKSARGTIEALWQDVFDWNENAFSVHAVYDSLFGQFVRREFFQRLAPKFGDNLTPFFINQSQTYYGIAKQGVQDLYYTCLANDPEFGDYNRTVLRNWTAKWLEGTVNALRDFMGIFAKLPTGTTHKAEIQASLERVIDDWTADHASRIDFKVDRDAIVRHVMSGLI

SEQ ID NO: 91 - DNA, 507 bp, Artificial Sequence
  Synthetic plasmid
atggcaaaaaacggtgtccatgacaacgccacacgcgatgcatgggttgtaaaaattgggcagttgaataccctggacaaagccgcggctgccttaaaacagtttcgtctcgatcataccactccgtttcgcaaaacttatgaactggataatgattatctgtggatcgaggctaaactggaggaaaaggttgctgtcctgaaggcccgcgctttcaacgatgaagacttccgccataaaaccgcttttggggaatgcgctaaaacgctcttagccgaagcggtcgcgaaaatggctgctacgggcgataaatgggaagcagaacgcattcatattggcttccgtcaagctaataaaccgcccattatgccggtgaactatttccttgaagccgaacgtgtccttggtacgaagctgatggaattgcgtaacctcaactactatgatacaccactggaagaactgcgcaaacagcgcggtgtgaaagtcttagtagcgccgcactaa

SEQ ID NO: 92 - protein, 168 aa, Methylocaldum sp.175
MAKNGVHDNATRDAWVVKIGQLNTLDKAAAALKQFRLDHTTPFRKTYELDNDYLWIEAKLEEKVAVLKARAFNDEDFRHKTAFGECAKTLLAEAVAKMAATGDKWEAERIHIGFRQANKPPIMPVNYFLEAERVLGTKLMELRNLNYYDTPLEELRKQRGVKVLVAPH

SEQ ID NO: 93 - DNA, 426 bp, Artificial Sequence
  Synthetic plasmid
atgtctgtgtccagcaatgcgtattatgcaggtacgacgggtctgtcgggcaaggagttcgctgaagcattcttcgcggatgaaaatcaggttgtgcatgaaagcgataccgtcgttttggtgctgaaaaaaagcgacgaaatcaacacatttatcgaagagatcctgctggaagattataaaaaacatgtgaacccaaccgtcaatgttgaagaccgcgccgggtattggtggatcaaagctaacggtaagattgaagtggactgcgatgaactgtccgagcttctgggtcgttccttcaacgtctacgacttcctggtggatgtgagcagcactatcggccgtgcatataccctgggtaataaattcacaattacctctgaattgatgggtttagaccgtaagttggaagattatcatgcataa

SEQ ID NO: 94 - protein, 141 aa, Methylocaldum sp.175
MSVSSNAYYAGTTGLSGKEFAEAFFADENQVVHESDTVVLVLKKSDEINTFIEEILLEDYKKHVNPTVNVEDRAGYWWIKANGKIEVDCDELSELLGRSFNVYDFLVDVSSTIGRAYTLGNKFTITSELMGLDRKLEDYHA

SEQ ID NO: 95 - DNA, 1104 bp, Artificial Sequence
  Synthetic plasmid
atggccgcaacccactcaattaaagtgattactgaagatggcgaagccgtgtactttgattgccgtcctgatgaagatgtcatcagtgctgccatccgccaggatatctatctgatgtcctcatgccgcgctggtggctgcgcaacctgtaaagcgttttgcccggaaggcgactaccgcttagtgggttgttcggtgcaagcactgccgcctgaagaggaagaagacggccaggttctgctgtgtcgctgttatccggactcggatctggagctggaagttccgtatacctactcacgtattgcatttgaaccggaagctaatgagttcccggccgaggtagtgagcgttggtaaagtcagctcgaatgcagttcgtctgcatttgcgccgcccgggtatgggcaacgaacgcaaagtccgttttgatgcaggtcagttcatggaactgcaagtacctggttcggcagtcacgcgcgcgtattccccggccaacatctctaacgacgccggcgacctggagtttcttattcgtttattacctgatggccttatgtctaatgctctccgtggcggtgccattcagccgggtcagacgttgcaggtcaaaggtccgcagggaatcttcggccttaaagaaaatggctttcgtccgcgctactttattgcgggtggcacgggcctcgcccctgtactgagtatggttcgccatatgcgtgagtggggtgcgccccagcagactcgcctgtacttcggcgtcaataccgaggaagaagtctttctgcgcgccgaactggaagccctggctgccgctatgccgaatttaaccgtgaaagtctgcgtgtggcgccctaccgatggttgggatggtgaacgtggcaacgcaatcgaggtactccgccgcgacctggaggcgcagccggcgcagcccgatgtctatctttgtgggccgccgggtatggtcgatgccgcgtatgccgtctgtgcagagtttggtatcccagcggaccaaatctatctggagaaattcttaccgtcgggaccgtgtggcgaggcctgtgacccgggtcaagtgcacggtcatcaccagcacgccacagcctaa

SEQ ID NO: 96 - protein, 367 aa, Methylocaldum sp.175
MAATHSIKVITEDGEAVYFDCRPDEDVISAAIRQDIYLMSSCRAGGCATCKAFCPEGDYRLVGCSVQALPPEEEEDGQVLLCRCYPDSDLELEVPYTYSRIAFEPEANEFPAEVVSVGKVSSNAVRLHLRRPGMGNERKVRFDAGQFMELQVPGSAVTRAYSPANISNDAGDLEFLIRLLPDGLMSNALRGGAIQPGQTLQVKGPQGIFGLKENGFRPRYFIAGGTGLAPVLSMVRHMREWGAPQQTRLYFGVNTEEEVFLRAELEALAAAMPNLTVKVCVWRPTDGWDGERGNAIEVLRRDLEAQPAQPDVYLCGPPGMVDAAYAVCAEFGIPADQIYLEKFLPSGPCGEACDPGQVHGHHQHATA

SEQ ID NO: 97 - DNA, 282 bp, Artificial Sequence
  Synthetic plasmid
atgacaattgatttcgatcatttggatccggatgccctggatttcttatcggctcgctcgttaagccaagttccagcaggtacccctcgcaccgaactatttcagcaaggtcgctacgcagcgtacgcacaggacctgggtttcgcatggcgctgggccattgcccgcgacgggcgcgatattcaagaaggcccggcgctgtcgctggaatctgcccacctgagcgcacgccgtgtactggcattctttgttcgcttagactcgccgccgacaccggcctaa

SEQ ID NO: 98 - protein, 93 aa, Methylocaldum sp.175
MTIDFDHLDPDALDFLSARSLSQVPAGTPRTELFQQGRYAAYAQDLGFAWRWAIARDGRDIQEGPALSLESAHLSARRVLAFFVRLDSPPTPA

SEQ ID NO: 99 - DNA, 1593 bp, Artificial Sequence
  Synthetic plasmid
atggccgcgagcaatcttgcagtgaaacaggcgttgaaaaacaaccctgcgccgtcgtcggttgacccgcaggaagttcataaatggttacaggacttcacttgggatttcaaagaaaaagcaggcaaatatcccacgaagtatgacatggatgtgaatacccgtgagcaatttaagttgacggcgaaggaatatgcgcgcatggagtcagccaaagaagaacgccaatttggtacccttcttgacggcctggatcgcctcgatgccggcaacaaggtgcatccgcgttggggcgaatttatgaaattagttgcaaacttcctggaaaccggtgaatatggtgcgctcgcaggttcggcacttttgtgggatactgcacaaagcccggaacaacgcaatggttacttagcgcaagtgatcgatgaggtgcgccacgtgaatcagtgcgcatcggttagttactattattcaaaacactattacgatcccgctggtttcacaaatatgcgccagttacgtgctattaaccctctgtatccaggtgtgaagcgtgctttcggtgaaggttttctggcgggcgatgccgtcgagtccagcattaatttacagctggtagcggaggcgtgctttaccaaccccctgatcgtagctttaaccgaatgggcggcggcaaatggggatgagatcactccaaccgtgttcttgagcattgaaaccgatgaattgcgccacatggcgaacggctatcagacgattgtgtctatcatgaataaccccgataccatgaaatatctgcaaactgatctggataacgccttctggacgcaacacaagttcctgacgccattcgtaggggcggcgttagaatatggttcgcgttttaaagtcgagccgtgggcgaaatcgtggaaccgctgggtttacgaggattgggcaggcatttggttaggccgcctgcaacaattcgggttaaaatccccaaaatgtctggccgacgcgaagaaagatgcagtctgggcacatcacgatctggccctcctggcgtttgcgttatggccgttaacaggtatccgcctcgaattgcctgaccgtcaggatatggaatggtttgaagcgaattatccgggctggtatgaacactatggaaaaatttacgaagaatggcgtgcccttgggttcgaagatccccgttccggatttagtggtgctgtgtggatgctgcagcgtggccatggcatttttattgaccatacgtcaagcctgcccttctgtccgacgttgggtaagggtgctctgaaaccttcgtttctggagaagaacgggaaacgttttgcattcagtgaaccgcacggtgaacgcatgtggttgcaggagccggagcgctacgaattccaaaacttcttcgagcagtttgaaggctgggaattgagtgacctcgtaaaagcggctggtggtgtgcgttcggacggcaaaactttgatggcgcagcctcatctgcgttccactgatatgtggactctggatgacctgaagcgtattaattttaccgtgccggatccgatgcgcattctgaactggcaaccggcccattga

SEQ ID NO: 100 - protein, 530 aa, Solimonas aquatica
MAASNLAVKQALKNNPAPSSVDPQEVHKWLQDFTWDFKEKAGKYPTKYDMDVNTREQFKLTAKEYARMESAKEERQFGTLLDGLDRLDAGNKVHPRWGEFMKLVANFLETGEYGALAGSALLWDTAQSPEQRNGYLAQVIDEVRHVNQCASVSYYYSKHYYDPAGFTNMRQLRAINPLYPGVKRAFGEGFLAGDAVESSINLQLVAEACFTNPLIVALTEWAAANGDEITPTVFLSIETDELRHMANGYQTIVSIMNNPDTMKYLQTDLDNAFWTQHKFLTPFVGAALEYGSRFKVEPWAKSWNRWVYEDWAGIWLGRLQQFGLKSPKCLADAKKDAVWAHHDLALLAFALWPLTGIRLELPDRQDMEWFEANYPGWYEHYGKIYEEWRALGFEDPRSGFSGAVWMLQRGHGIFIDHTSSLPFCPTLGKGALKPSFLEKNGKRFAFSEPHGERMWLQEPERYEFQNFFEQFEGWELSDLVKAAGGVRSDGKTLMAQPHLRSTDMWTLDDLKRINFTVPDPMRILNWQPAH

SEQ ID NO: 101 - DNA, 1176 bp, Artificial Sequence
  Synthetic plasmid
atgtcctcgaactcgtttgtacgtggtatggtagatccttatcgtcagaccatcattcaggcagcaattccggaacagccgttagaaagcaaacgcgatcatattccttttgcgaagcgcggttggcgccgtctcactgaatatgaggcggtgatgctccacgcacagaatagcgtagactccgtgccgggctcacaggaggtgggtgagtctgtacagaaatggccgggcggtcgcccgaattactctattgagtctactgctgttattgcaggtaattggttttactttcgcgacccagcgaaacgctggttcatgccgtatgttaagcagaaaacggaagaaggtcaaaccgctgagcgtaccatgaaaagctgggcagagtccggagatgccggaatgatgaacgccgattggcgtaatcaaatcctgggtacccactatggcgccttggtgtataatgaatatggcctcttctccgcacattcgacgacagtttatagtgctctgtccgacttgctgaagacctggatctcggaagcagggttcgataaaaatgatgccggccaaatgattcagatggaacgtattctgctcggcaaattgtttgctgatttcgacccgagtctggccgctgctaaacaggcctggatgcaagacccgatttggcaaccggcgcgtgaattcgttcagcatatctggatgggtgtctatgattgggttgaacagctgtgggccatccatggcatttacgatcacattttcgggcaattcgtgcgccgtgaattcttccagcgcctggcgggcctgcacggtgatacgcttactccctttatccaatcccaggctctgacgtaccatcaacaggccagcgacgcgctgcaagccttttgtgtaaaaatgttgatcgacgaagagccggtatacggggctcacaatcgccgctacctgcgcgcatggaccaagcgttatctccctggcacccaggcggcgctgaaagcgttcctggctatctacaaaaccctgccgctgcaagtggaaggaattacctgcaaagcaagtgtagaagcagcagtgcgtcgcattgtgaacgattgggcccgccgttttgccgaaccgatcgattatcgctttgatgcagaagcattcattgccgacgtcatgcaggggtactaa

SEQ ID NO: 102 - protein, 391 aa, Solimonas aquatica
MSSNSFVRGMVDPYRQTIIQAAIPEQPLESKRDHIPFAKRGWRRLTEYEAVMLHAQNSVDSVPGSQEVGESVQKWPGGRPNYSIESTAVIAGNWFYFRDPAKRWFMPYVKQKTEEGQTAERTMKSWAESGDAGMMNADWRNQILGTHYGALVYNEYGLFSAHSTTVYSALSDLLKTWISEAGFDKNDAGQMIQMERILLGKLFADFDPSLAAAKQAWMQDPIWQPAREFVQHIWMGVYDWVEQLWAIHGIYDHIFGQFVRREFFQRLAGLHGDTLTPFIQSQALTYHQQASDALQAFCVKMLIDEEPVYGAHNRRYLRAWTKRYLPGTQAALKAFLAIYKTLPLQVEGITCKASVEAAVRRIVNDWARRFAEPIDYRFDAEAFIADVMQGY

SEQ ID NO: 103 - DNA, 507 bp, Artificial Sequence
  Synthetic plasmid
atgagcaagcagcattggtatcacacgccaacgcgtgatgagtggctggaacgcattggtaccctgcgcaccgcccgtgaaggaattgaaatgttgcgcaactttcgtgagcagcatctgggtccagaccgcaagacttatgatctgaagaaagaagcaaattggattgagtcgcgtattgaaatgcgtgtgtcccagctgcacgccgaggaaactctgagtgatgacgatctcctgcacaaaacgattgatggccgctgcgcccgtgaggttgccaatagttggtgggaaaaagcagcacaagttgattccgcaatcgaactgggccagctctgcgtggcctaccgtaaggcgtgtaaaccaccgatgatgcctattaattactttgcgccagtcgagaaaaaattggttagtaaactgctgaaattgcgcgcggaaaattacctggtgacgcctatcgaagaactgcgtaaagcccgtaatgttacacctatccatgtgcagtga

SEQ ID NO: 104 - protein, 168 aa, Solimonas aquatica
MSKQHWYHTPTRDEWLERIGTLRTAREGIEMLRNFREQHLGPDRKTYDLKKEANWIESRIEMRVSQLHAEETLSDDDLLHKTIDGRCAREVANSWWEKAAQVDSAIELGQLCVAYRKACKPPMMPINYFAPVEKKLVSKLLKLRAENYLVTPIEELRKARNVTPIHVQ

SEQ ID NO: 105 - DNA, 417 bp, Artificial Sequence
  Synthetic plasmid
atgtctactaacatcaacggttataattcgggtaccaataacaagacgggacaagcatttgtcgacgaatttctgagcgaaaaaaactgcaccctgcctacgtccgacgcggtagtgcttgccctgatgaagacagaagaaatcaatgttatcgtcgatgaaatgattcgtccaatgatggatgacaacccggccctggccgtcgacgatcgtggtgggtactggtggattaaagtgaacgggaaaatcgtcatcgactgtgatgaagcaactgagattttgggcaaaaaatataccgtgtacgattttctggttaatgtgagcaccacaattggtcgtgctatgaccctggggaaccaattcgtactgaccaatgaactgttgggtctggaaactaaaatcgattcagtgtactaa

SEQ ID NO: 106 - protein, 138 aa, Solimonas aquatica
MSTNINGYNSGTNNKTGQAFVDEFLSEKNCTLPTSDAVVLALMKTEEINVIVDEMIRPMMDDNPALAVDDRGGYWWIKVNGKIVIDCDEATEILGKKYTVYDFLVNVSTTIGRAMTLGNQFVLTNELLGLETKIDSVY

SEQ ID NO: 107 - DNA, 1056 bp, Artificial Sequence
  Synthetic plasmid
atggattcgcgttacaccatcacggctaactttgaagacggcgccctccatcagttcgaatgcgcggaaaacgaagatatcctgtcagcggcgcttcgtcagcaggttgtgctgctgtgctcttgccgcaaagcgttctgcggatcttgtaaagcgctgtgtatggaaggtgaatacgcctttggggatcgtgtaaatgtacaggtgctgtcgccgaaagaagaagaggatggtgtcgtggtggcgtgtgacacttttccccgtagcgatatggcactggcattcccatataccagtgaccgcctgggatcatgttcttccgaaaatctcgaagctcaggtggagatcgttgagcgcctgtctagcactgtgtacaagctgctgctgcaggttcgtgatccggtgagtcatgaagctaagcgtatcgagttccaaccgggtcaatacgccgaattgcagctgccggatggtgagcaaacacgtgcgttttcgtttgcaaatatcgcggacgattctggcttgctcgaatttctgatccgcttggttccgggtggatgttttagtacctatctgcagcagcgtgcagttccgggcgacgtgctgaagctgcgcgcgccgcttggtgccttcacgttccaaccgggggaccaagacgaaggcctgcacgcgtttgtgggaggttcgaccggattggcccctttgctgtctatgctgcgtggtttagcccgccaagattatcgcggcgaatgtcatctgttttttggtatgcaggaccaagccgcgctgtactacgaagacgagctgcgcgaattagcggcaagtatgccacgcttaaccttgcatctcgctctcatggatcctccgccacaatggcagggctacacggggaatgccgtgaccgcgtttgaacaacactttgccgctttagcgcgcaagccggaagtctatatctgcggtccggctgcaatggttgaggccactcgcgcatcttgtgaacgtctgaatatcccggagcaccgcgtgcaccgtgaggaatttgtcgccagcggaggttaa

SEQ ID NO: 108 - protein, 351 aa, Solimonas aquatica
MDSRYTITANFEDGALHQFECAENEDILSAALRQQVVLLCSCRKAFCGSCKALCMEGEYAFGDRVNVQVLSPKEEEDGVVVACDTFPRSDMALAFPYTSDRLGSCSSENLEAQVEIVERLSSTVYKLLLQVRDPVSHEAKRIEFQPGQYAELQLPDGEQTRAFSFANIADDSGLLEFLIRLVPGGCFSTYLQQRAVPGDVLKLRAPLGAFTFQPGDQDEGLHAFVGGSTGLAPLLSMLRGLARQDYRGECHLFFGMQDQAALYYEDELRELAASMPRLTLHLALMDPPPQWQGYTGNAVTAFEQHFAALARKPEVYICGPAAMVEATRASCERLNIPEHRVHREEFVASGG

SEQ ID NO: 109 - DNA, 300 bp, Artificial Sequence
  Synthetic plasmid
gtgaacacgcgcagcggcgatacgccggctattccccgtcttgacggcctgccccaggcagtgggcgccacggtgctgattcatgaagacggtgaatttcgtgtgtatgcgacggaacttgaaatgctgctgcgctgggatctgttccagggcgatcgccatctgcacaccggttcagctctccgcgttgaaagctgtatcgtttcagccaagggcaaaattggcttttttcgccgtcctactgttgcacgtctgatcgccgcaggcgacgaggcaagccccaacgatccgagctaataa

SEQ ID NO: 110 - protein, 98 aa, Solimonas aquatica
MNTRSGDTPAIPRLDGLPQAVGATVLIHEDGEFRVYATELEMLLRWDLFQGDRHLHTGSALRVESCIVSAKGKIGFFRRPTVARLIAAGDEASPNDPS

SEQ ID NO: 111 - DNA, 1650 bp, Artificial Sequence
  Synthetic plasmid
atgagtcgtcaatctatgtcgaaagcccataaaaagatcacagagctgtcctgggagccgacgtttgccactcccgccaaacgttttggtaccgactacacatttgacaatgctccgaaaaaagatcctctgaagcagattttacgctcgtactttcccatggaggaggaaaaagattcacgcgttttcggagcgatggacggggccatccgtggtaatatgtttcgccaggtgcaggagcgttggatggagtggcagaagttgtttctgtcaattatcccgtttcctgaaatctccgcggcacgtgccatgccaatggcgattgacgccgtgcccaacccagagattcataatggtttagctgttcagatgattgatgaagtgcgtcattcgacgatccaaatgaacctgaaacgcctgtacatgaattactacatcgatccagcgggttttgatatgaccgaaaaagctttcgcaaataactacgctggtacaattggccgtcaatttggcgaaggttttattacaggggatgcgatcacggcagccaatatctaccttactgtggttgcagaaactgcattcaccaacacgctgtttgtggcgatgccgagcgaagctgcggccaatggagactatctgctgccaactgtgttccacagtgtccagagtgatgaatctcgtcatatttcaaacggttactccatccttctgatggcgttgtcggacgaggataaccgtcagctgttagaacgtgatcttcgctatgcctggtggaacaaccaccgcgtcgttgacgccgcgattggaaccttcattgaatatggtaccaaagatcgtcgcaaagaccgtgagtcgtatgcggaaatgtggcgtcgctggatttatgacgattattatcgtgcgtatctgattccgctggagaaatacgggcttgtgatcccacacgatctgatcgaggagtcgtggaaacaaatttgggagaaaggctatgtccatgaggtcgcccagttttttgcgacaggctggcttgcgaattattggcgcattgattccatgactgatgaagatttcgaatggttcgaatacaagtatcctggctggtatgataaatatggtaaatggtgggaaaactataatcgcctgagcaaaccgaacggccacaatccgattgtgtttgaagatgtagattatgtgtacccggcacgctgttggacgtgcatgagcccctgctggtcagtccgcacactcgttacggcggaagttgatggccaacatcgcacctattgccacgaagtatgtcgttggacggatgtgcgtgggttcccatccgatgtgccgggtcgtgaaaccccaaatatgggtcgcttagtgggtaaacgtgagtgggaaacgttgtaccacggttggaattgggcagatgttgtttcggatatggggtttgtacgtgatgacgggaagacgatgaccccgaaaccgcatctggatctggatccaaaaaaaatgtggaccctcgatcacatgcgtcgctgtccgcccctgcagtcgccgaatgtactgtttaacgaaatgtccgacgcggagcgtgctgcctatgtcgcggactacaacaaacagggccctgctggtcgtccggccccgcaatcgtaa

SEQ ID NO: 112 - protein, 549 aa, Pseudonocardia TY7
MSRQSMSKAHKKITELSWEPTFATPAKRFGTDYTFDNAPKKDPLKQILRSYFPMEEEKDSRVFGAMDGAIRGNMFRQVQERWMEWQKLFLSIIPFPEISAARAMPMAIDAVPNPEIHNGLAVQMIDEVRHSTIQMNLKRLYMNYYIDPAGFDMTEKAFANNYAGTIGRQFGEGFITGDAITAANIYLTVVAETAFTNTLFVAMPSEAAANGDYLLPTVFHSVQSDESRHISNGYSILLMALSDEDNRQLLERDLRYAWWNNHRVVDAAIGTFIEYGTKDRRKDRESYAEMWRRWIYDDYYRAYLIPLEKYGLVIPHDLIEESWKQIWEKGYVHEVAQFFATGWLANYWRIDSMTDEDFEWFEYKYPGWYDKYGKWWENYNRLSKPNGHNPIVFEDVDYVYPARCWTCMSPCWSVRTLVTAEVDGQHRTYCHEVCRWTDVRGFPSDVPGRETPNMGRLVGKREWETLYHGWNWADVVSDMGFVRDDGKTMTPKPHLDLDPKKMWTLDHMRRCPPLQSPNVLFNEMSDAERAAYVADYNKQGPAGRPAPQS

SEQ ID NO: 113 - DNA, 1032 bp, Artificial Sequence
  Synthetic plasmid
atgggagataaacatgtagtccgttttgaaccggtgggtatcgaaattgaagttgatgaagatcagaccatcctgcgtgcagcagccgaacagggtgtgcagctgatgcacggctgcaaagaaggtcagtgtgcggcctgcaaaagctttgttctggaaggtgaggatattgagctggacagttactctatttttacactgccagattacgagaaagaggagggatcgacgttgctgtgtcgtgcgcatgcctatgaagacttgaccattgaactgttgaactatgatgaagaaattattcgcagcggtctgccgctgcgtaaaggtaaggtccaggtagtagcaaatgatgaagttacccatgacctgcgtcgtctggtagtaaaactgattgaaccggaagagattaaatttttccccggacagtacatggatttcatcgttccaggaactgaagagtcgcgtagcttctcaatggccaatacaccaaaccgtgaaggcgaattcgaatttgtgatcaagatttatccagatggcctttttagtgaatttctggccgagaaagttcaagtgggtgatcagctggaagtggaagcgccgtttggcacttttaccttacgcgagaaccgtacgtcagatatcgtttttgtgggcggcggcgcgggtatggcgccaatcctgggtctgctgcgttctatggcagaacgtggcgtggaacgccgcgcccgcttctattacggcgcgcgtgcgacacgcgacctttgctttgccgaagaaattgccgcgctgggtgaacagctgccgagtggccttacatataccccggcgctgagccatcctgacgacgaaccgtggagcggccagaccggcctgatcaccgaggtgttacaggccaatgaaagtacactggagggcgcggatgcctacgtatgtggtccaccaccaatggtcgacgccgcgattgcgacccttaccgcccttggtgtgcgtgaggaaaacattttctatgataaatttaccacccaccgctga

SEQ ID NO: 114 - protein, 343 aa, Pseudonocardia TY7
MGDKHVVRFEPVGIEIEVDEDQTILRAAAEQGVQLMHGCKEGQCAACKSFVLEGEDIELDSYSIFTLPDYEKEEGSTLLCRAHAYEDLTIELLNYDEEIIRSGLPLRKGKVQVVANDEVTHDLRRLVVKLIEPEEIKFFPGQYMDFIVPGTEESRSFSMANTPNREGEFEFVIKIYPDGLFSEFLAEKVQVGDQLEVEAPFGTFTLRENRTSDIVFVGGGAGMAPILGLLRSMAERGVERRARFYYGARATRDLCFAEEIAALGEQLPSGLTYTPALSHPDDEPWSGQTGLITEVLQANESTLEGADAYVCGPPPMVDAAIATLTALGVREENIFYDKFTTHR

SEQ ID NO: 115 - DNA, 1188 bp, Artificial Sequence
  Synthetic plasmid
atgacgaccacagaacgtccggaacgttccgtgcctaaacctgtgttcaccgatgcggaggcaggcgcccacgagtttcctgatagcggagcatccgcgcgccgttataattactataactcaatcaacgcaagccgtacgcactatgaagatgtaacggtggatgtgcagccggatccgcgtcattatttgtcgcagggctggatctacgggttcgcggatggatctgcacgctaccctctgacctggacgaaattgaaagccgtgggccgtggctcggcgcgcgcgcgtgcattacctcgtttacgtcgtcagggccttcgcgtctgtccgccgaccgcttggcatgaatttcgcgacccaaacgaggagtgggaattgaccttttatcgctataacgctaatgtggtgcgccaggttaaccagaatattgaaaatgcccgctatgcgaaagcgttcgaacagtggacacccaactggattcagttcgtggaacgtaatgtcggcgcctggatgcacattgagcatacgttgggcctgtatgtcttcgctgcctgcaatcgttctgggcctactaacatgcacaataccgcaatggcgtacaccgcttgccataaaattcgttttgcacaggatcttgcactgtataacttaaccctcactgaagaaattgaaggcttcgatggaactgcacatttggaggcgtggaacagcgatccggagtggcaggccagtggtcgcagtcatgaagcgctgaccgccgtggatgacgactggggcgaaagtatttttgccacgaatgtggtgttcgaaccgttgcttcgcgagctgtttcgcagtaaccttgttatgcaggcggctgccggtaacggtgatttcgttaccccgacggtgatgggcgcggcggaatttgattttgcgcaacgtgacttacgttggacccaagcttgttttggtcccttaacccaagataaggaatttgccgattataacaaagatctcatgcaaggatggctgtctcattgggttccgcaggctatcgaagcggctcgcgttttgcagccgatctggtcgctgccagacgctaaaccaccgcgctttgaagattcattagaccgtgcaaaaagccgttttagcggtattgtaacggacttagggttatctgtgccgaaggaactgtcacaataa

SEQ ID NO: 116 - protein, 395 aa, Pseudonocardia TY7
MTTTERPERSVPKPVFTDAEAGAHEFPDSGASARRYNYYNSINASRTHYEDVTVDVQPDPRHYLSQGWIYGFADGSARYPLTWTKLKAVGRGSARARALPRLRRQGLRVCPPTAWHEFRDPNEEWELTFYRYNANVVRQVNQNIENARYAKAFEQWTPNWIQFVERNVGAWMHIEHTLGLYVFAACNRSGPTNMHNTAMAYTACHKIRFAQDLALYNLTLTEEIEGFDGTAHLEAWNSDPEWQASGRSHEALTAVDDDWGESIFATNVVFEPLLRELFRSNLVMQAAAGNGDFVTPTVMGAAEFDFAQRDLRWTQACFGPLTQDKEFADYNKDLMQGWLSHWVPQAIEAARVLQPIWSLPDAKPPRFEDSLDRAKSRFSGIVTDLGLSVPKELSQ

SEQ ID NO: 117 - DNA, 375 bp, Artificial Sequence
  Synthetic plasmid
atgacgtcttttaagacggcagaatctccctttaaagcagataacacggcttcgggaaaggctggcgtgacccttatgaacaatcaaattggtgtggtggttgcagaagtaatggatcagcaagaaaatgtaaccattacacacttgccgagtatgattcgtgttgactgtgtgggtcgcatggattttgtgtatgacgatatctcggaagcgctgggcgaggagccggggttttacgacgctgcggaattcgaagaaaacatgagcacccattacgggaagatgattcacatggatgaccgtactgtaatgtttgggaacttagaagaagccgcagaattcattggtgatatgctgccgcctccggttaaataa

SEQ ID NO: 118 - protein, 124 aa, Pseudonocardia TY7
MTSFKTAESPFKADNTASGKAGVTLMNNQIGVVVAEVMDQQENVTITHLPSMIRVDCVGRMDFVYDDISEALGEEPGFYDAAEFEENMSTHYGKMIHMDDRTVMFGNLEEAAEFIGDMLPPPVK

SEQ ID NO: 119 - DNA, 288 bp, Artificial Sequence
  Synthetic plasmid
atggctttcagacccttgcatgatagagtggtcgttaaacgattggaaggagaagataaaaccaaaggtggaatcatcattccagatactgccaaggaaaagcctgctgagggtaagatcattgccgttgggcctggcgcaagagatgagtccggaaaattggtcgcactggatgtcaaagaaggtgatcgagttttgttcggtaagtggagtgggaccgaggtaaagatagacggagaggaccttttgattatgaaggagtctgacatcttgggcgtgatcgcttga

SEQ ID NO: 120 - protein, 95 aa, Methylocystis sp. LW5
MAFRPLHDRVVVKRLEGEDKTKGGIIIPDTAKEKPAEGKIIAVGPGARDESGKLVALDVKEGDRVLFGKWSGTEVKIDGEDLLIMKESDILGVIA

SEQ ID NO: 121 - DNA, 1683 bp, Artificial Sequence
  Synthetic plasmid
atggcaagaaatattagatttggtgatcccgttagaaaaagacttctggatggagttgactttctagctgacgctgttggtgttaccttggggccatgtggaaggaatgttgtcatcgaacatagggcctccggcttaccacccgtagccaccaaggacggtgcaacggttgctcaggccgttgaagccgccggtcgtactgaaagtgttggtatcaatttagttagacaaatggccactaccgttgcaaaagaggctggtgatgggacgacaacctctgtcgttttgacacgaagggtggctgccgaaactcgtaaggcccttgcagctggaatgaatccccgtgacatcacattaggcatggagagggccgcaagagcagttgaagcagacttgttgagacgtgcaagacgttgcaacgaccagaggtcattggctcatgttgccaccctagccgctggtggagatgagggtatcggtgctattgttgcacaagctttggccttagccggtgagggaggagttgtggatgtagaactaggtcacggcgtcgccgatgacatcgagtctgttgagggcatgagatgggagcagggctaccgttccccatatttcatgacagactcagctaggaaggtagctgagctggaaaatccttatattctggtctatgatagagttatcaacgaattctctgagctggttcctgcacttgagttggtcagaagatctggcggatctcttctagttgtagctgaaaacataatggaggaagcccttccaggcttgttgttgaaccatattagaaaaaatttgtgctccattgctgtgaaggggccaggatatggtgattcaaggtatgaatatttattggatttagctgctataaccggaggtagggctatcatggaagcattcggtgaagacatttccaatgtaactatggagcacttgggtcgtgctagaagagtcgttgttagggaagatgatacgctagtcattggtggtgagggagatcctaacgtaatcgcagatagactagcaagtgctaaacgtcaggcagattggattgttgaaggagacgcatctaagggctccccttcaggaaaaagacatgagttagaaaacttgcagacacgaattaaggccctgagtggacgtatggcaacaattagggctgggggcctgtctgacgtgctgattaaggaaagaatgcaaaggatcgaaaatgctttaaactctgctagggccgcacaatctgatggagtcgttgctggaggtggagtgggtttgtatcgagcaagggctgccctggctgaattaaggggtgagaacctggaccagtctcacggcgttgccattgtgcgtgcagcactggatgaacctatcagaagaatcgcagccaacgctggggtggatgctgatgaattcttgttcgagctacgaagaagtaatgatgatttctggggcatggatatgagaagtggtgcttgtggtgatcttttcgctgcaggagttattgatccagttcgagtaaccagacttgccttaagaaatgcagttgccactgcagcctctcttatgaccgttgaatgtgccgtcacacatattcctgtttctgaccctactttcggatttgatgctagaagagccgctgaaacgagagaagatcctagagcctaa

SEQ ID NO: 122 - protein, 560 aa, Methylocystis sp. LW5
MARNIRFGDPVRKRLLDGVDFLADAVGVTLGPCGRNVVIEHRASGLPPVATKDGATVAQAVEAAGRTESVGINLVRQMATTVAKEAGDGTTTSVVLTRRVAAETRKALAAGMNPRDITLGMERAARAVEADLLRRARRCNDQRSLAHVATLAAGGDEGIGAIVAQALALAGEGGVVDVELGHGVADDIESVEGMRWEQGYRSPYFMTDSARKVAELENPYILVYDRVINEFSELVPALELVRRSGGSLLVVAENIMEEALPGLLLNHIRKNLCSIAVKGPGYGDSRYEYLLDLAAITGGRAIMEAFGEDISNVTMEHLGRARRVVVREDDTLVIGGEGDPNVIADRLASAKRQADWIVEGDASKGSPSGKRHELENLQTRIKALSGRMATIRAGGLSDVLIKERMQRIENALNSARAAQSDGVVAGGGVGLYRARAALAELRGENLDQSHGVAIVRAALDEPIRRIAANAGVDADEFLFELRRSNDDFWGMDMRSGACGDLFAAGVIDPVRVTRLALRNAVATAASLMTVECAVTHIPVSDPTFGFDARRAAETREDPRA

SEQ ID NO: 123 - DNA, 291 bp, Artificial Sequence
  Synthetic plasmid
gtgaaaatccgtccgctgcatgatcgtgttattgtcaagcgtctcgaagcggagcgcaaaacggcctcaggaatcgttatcccagattcagcaggcgagaagccggaccaaggagaagttctggcggtgggtaacggtaaaatccttgacgacggtaaagtccgtccgatggccgtcaaagtgggtgataaagttctgttcggtaagtatgctggtcaaaccgtcaaagtggagggcgaggagctcctggtgatgcgtgaagaagatattatgggtgtggtggaggcttaa

SEQ ID NO: 124 - protein, 96 aa, Thauera butanivorans
MKIRPLHDRVIVKRLEAERKTASGIVIPDSAGEKPDQGEVLAVGNGKILDDGKVRPMAVKVGDKVLFGKYAGQTVKVEGEELLVMREEDIMGVVEA

SEQ ID NO: 125 - DNA, 1707 bp, Artificial Sequence
  Synthetic plasmid
atgattagccttaattgcaaaaaaaccactaccggtctgaccgcacatttggctctggtgcgcggcatgaaagccttagcggagctggtgggtacgacattaggaccccaaggtcgccacgttatgttagcacaccgtgccgggctggcgccgcacgtaagcaaagacggtgtggaagttgcgcgtcatctgtccctgcccgattcggaagaggaattaggtgttcgcttactgcgtaatgcggctgttgcagtctccgagtcatttggcgatgggacctcaaccgccaccgtcttcaccgcggatctggccgtgcgcgcgcttaaattgattggtgccggtgcggatacattagaagttcgccgtggtctgggcttggcggcctatgctgcgctggttgcactgaacgatatggcccgccgtgcggaccgcggaatgctgacggccgtagctcaaacggccgctaacggtgaccgtcgcgtggctgacttgttagtggaggcgtttgaacgcgtgggcgcggaaggaacaattgaagtggaaatgggtaacagtgtagaggatgttttggaagtggcacaagggagctattttgataccgtgcccttggttaccgcactgctgccaccgaccggccaagtagaatttgcgcgtccgttgattcttttccattgcgatgccattgaaaccgcagatgaaattcttccggccctcgaactcgctcgttctagccgtcgcccactgcttattctggcggactccgtgggtattgatgttgaaactctgcttgtccgcaatcaaaatgaaggcaccttagcggtggcagtagtacgtgcaccgatgtatggtgacacgcgccgtgaagctctcctggatctgacgtcaaaatttggcggaactgcgttcggccgcgagggctttgtcgaattcgcgctgcgtagcttaggcagcctgagcgaaggagatctcggtcaggcggacgaggccattttggaagcagatggcgtgactttacgcggggcgggaaataacccctccgccctggaagatcgtattgcactggttcgcgcggaactggatcgcggagatgtgtccgttggggattcgccgtccgcaaaactcgactacattgagaaacgcaaagagcgcttaaaactgcttgccgccgggagcgcaaaactgcatattgggggcccgaccgatgtcgagatcaagacgcgtcttccgctggcagagaatgcgcatcgtgctttgctggccgctgccaagtctggtgttctgcctgggggcggtgtcgccatgattcgcgcggcagaaaaagtacagcaggaaatgggccgtctggagggcgatgtggcgtccggtgcctcgatttttctgcagagcttagatactcccattcgctggattgcgcgtaacgcgggtctgcgcccggacgaagtcctggcacgcacattggcaaacgaatctgatttttacggtctgaacgcgatgacgggtcgctacggcgacctggcagaagatggtgttctcgatgctctggacatggtaaccgacgttattcgtgtggcggtgtcggtagtcggaagcatgctcggagtaggcgcactggtcacgcgcgcgagtccgaaaccggcgccggaacgtttcaagggaacggagcgcgtacacgataaactgatgcgcgaaggtggttttgatgagtga

SEQ ID NO: 126 - protein, 568 aa, Thauera butanivorans
MISLNCKKTTTGLTAHLALVRGMKALAELVGTTLGPQGRHVMLAHRAGLAPHVSKDGVEVARHLSLPDSEEELGVRLLRNAAVAVSESFGDGTSTATVFTADLAVRALKLIGAGADTLEVRRGLGLAAYAALVALNDMARRADRGMLTAVAQTAANGDRRVADLLVEAFERVGAEGTIEVEMGNSVEDVLEVAQGSYFDTVPLVTALLPPTGQVEFARPLILFHCDAIETADEILPALELARSSRRPLLILADSVGIDVETLLVRNQNEGTLAVAVVRAPMYGDTRREALLDLTSKFGGTAFGREGFVEFALRSLGSLSEGDLGQADEAILEADGVTLRGAGNNPSALEDRIALVRAELDRGDVSVGDSPSAKLDYIEKRKERLKLLAAGSAKLHIGGPTDVEIKTRLPLAENAHRALLAAAKSGVLPGGGVAMIRAAEKVQQEMGRLEGDVASGASIFLQSLDTPIRWIARNAGLRPDEVLARTLANESDFYGLNAMTGRYGDLAEDGVLDALDMVTDVIRVAVSVVGSMLGVGALVTRASPKPAPERFKGTERVHDKLMREGGFDE

SEQ ID NO: 127 - DNA, 288 bp, Artificial Sequence
  Synthetic plasmid
gtggcgtttcgtccgctgcacgatcgtgtggtggttaaacgtctggaaggcgaggacaaaactaaaggtgggattattatcccggatacggctaaagaaaaaccagcggaaggtaaggtcatcgcagtaggtccaggttcccgtgatgaaagcggcaaactggttgcgctggatgtgaaagaaggcgatcgtgtgctgttcggcaagtggagcggcacagaagtcaaaatcgatggagaagatttgcttattatgaaggaatctgatatcctgggcgtaatcgtataa

SEQ ID NO: 128 - protein, 95 aa, Methylosinus trichosporium OB3b
MAFRPLHDRVVVKRLEGEDKTKGGIIIPDTAKEKPAEGKVIAVGPGSRDESGKLVALDVKEGDRVLFGKWSGTEVKIDGEDLLIMKESDILGVIV

SEQ ID NO: 129 - DNA, 1746 bp, Artificial Sequence
  Synthetic plasmid
atgactaatccgcgtaaacgcgaacgccgtcgtccggcattcgatgtcacacgtgaaaaattcgttgcccgtaacattcgctttggtgatgtggtccgccgtgatttattagcgggcgtggatgcccttgcagacgcggtagcggtgaccttaggcccgcgcggccgtaacgttgtaatcgaacatcgcgcggcaggtttgccgccagtagcaaccaaagatggagtgaccgtagcgcaggccgtggaattggcgggtcgcacccagtccgtcggtgtgagcttagtacgccagatggcgacggctgtagccaaggaggcgggcgatgggaccaccacgagcgttgtgcttgctcgtcgcttggcagccgaaacccgcaaagccctggcagctgggatgaatccgcgtgatatcgtactggggatggaaaaagcggcccgcattgtggatcgtgacctcgcggctcgtgcacgccgttgcgatgacacacgtgcccttgcgcacgtcgctaccttggctgccgggggtgatgagagtatcggtgccattgtggcggatgctttaacacgtgcgggcgagggcggcgtagtagacgtggaactgggtgctgcactgtgtgatgagatggacattgttgagggcatgcgctgggaacagggttaccgctcaccgtatttcatgacggactctgcgcgcaagatcgcagaactggaaaatccttacattctgatctacgatcgtgttattaatcaattttccgaattagttccggcgttagaattagtccgtcgccaacgcggcagcctgttaatcgtcgctgaaaacattgtggaagaggccctccctggcctgctcctgaatcatattcgtaaaaatctgtgttctatcgccgttaaaggtccgggttatggggactcccgttacgaatttctgcacgatctggcggccttaaccggaggccgtgcgatcatggaggcgtgcggcgaggagttgtcaaacgttaccatggcccatctgggacgcgcaaaacgtgtagtggtgcgcgaagatgatacggttgtgatcggcggggagggggacggtgcggccatcactgagcgtctggccgcggcgcgtcagcaggcagattggattaccgacggcgatccaagcaaaggaagcccatccggaaagcgccacgatttagaaaacctgcagacccgcattaaagctctgagcggaaaggtagtcacgattaaggccggcggccttagtgatattctgattaaagaacgcatgcagcgtattgagaatgctctcgcatcggcgcgcgcagcccgctccgacggagtcgtggccggcggcggcgtgggactgtatcgcgcccgcgctgcgttgactgaggcaacgggcgacaccttggatcaaacctacggcattgcgattgtacgcgctgctctcgacgagcccattcgccgtattgctgcgaacgcggggcgcgatgcacatgaatttctgtttgaactcaaacgctctaacgatgatttttgggggatggatatgcgcagcggtgaatgcggagatctttatgccgcgggcgtcattgatccggcgcgtgttacccgcctggccctgcgcaacgcggtagctacggctagcagcctgatgaccgtcgaatgcgcagtaactcatatcccaccttctgaccccacctatggttttgatcctcatttggcggcggcaacccgtgaagacccgcgctcataa

SEQ ID NO: 130 - protein, 581 aa, Methylosinus trichosporium OB3b
MTNPRKRERRRPAFDVTREKFVARNIRFGDVVRRDLLAGVDALADAVAVTLGPRGRNVVIEHRAAGLPPVATKDGVTVAQAVELAGRTQSVGVSLVRQMATAVAKEAGDGTTTSVVLARRLAAETRKALAAGMNPRDIVLGMEKAARIVDRDLAARARRCDDTRALAHVATLAAGGDESIGAIVADALTRAGEGGVVDVELGAALCDEMDIVEGMRWEQGYRSPYFMTDSARKIAELENPYILIYDRVINQFSELVPALELVRRQRGSLLIVAENIVEEALPGLLLNHIRKNLCSIAVKGPGYGDSRYEFLHDLAALTGGRAIMEACGEELSNVTMAHLGRAKRVVVREDDTVVIGGEGDGAAITERLAAARQQADWITDGDPSKGSPSGKRHDLENLQTRIKALSGKVVTIKAGGLSDILIKERMQRIENALASARAARSDGVVAGGGVGLYRARAALTEATGDTLDQTYGIAIVRAALDEPIRRIAANAGRDAHEFLFELKRSNDDFWGMDMRSGECGDLYAAGVIDPARVTRLALRNAVATASSLMTVECAVTHIPPSDPTYGFDPHLAAATREDPRS

SEQ ID NO: 131 - DNA, 291 bp, Artificial Sequence
  Synthetic plasmid
atgaacattcgtccgctcaatgatcgcgtgattgtaaaacgtcttgaagaggaacgcacgtcaccgggtggcattgtgatcccggattcagccacagagaaaccgtcccgtggtgaaatcctggcggtcggcacgggtaaaaccctggataatggtcaggtacgtgccttggccgtcaaagcgggcgacaaagtgctgtttggtaaatacgcggggacggaagtcaagattgacggccaggagattcttgtgatgcgtgaagaagatattattgcggtgcttgaggattaa

SEQ ID NO: 132 - protein, 96 aa, Methylocaldum sp.175
MNIRPLNDRVIVKRLEEERTSPGGIVIPDSATEKPSRGEILAVGTGKTLDNGQVRALAVKAGDKVLFGKYAGTEVKIDGQEILVMREEDIIAVLED

SEQ ID NO: 133 - DNA, 1683 bp, Artificial Sequence
  Synthetic plasmid
atgtcaaagcgcctcgtcttcgatggcgaagcccgcgcgggaattttaaaaggtattgatattttgggtcgtgcggttgagactacttacggttatcaggggccttgcgtaatggtacaacaccgcactcagggtctgcctccgttctttacacgtgatggcgtaacggttgcgaactcggtcgttctgggtgatcgcctggccgatcttggcgcacgtatgctgcgtgacgttgcgaacgcggtatctcgcgaagcgggtgatggcacaacaaccgccgtggtgctggcgcgcgcaatcgcgcgcggccttttacgttccttggcagcgggggcggatccgcatcgtttgcgcgagggaatggacgctgccgttaagctggtggaggatgatctgcgccgccgcgcgctgcctcttcaaggggatatggttgctcaagttgcagaagtgtcaatgcgcaaagaagggcaggttggccgcttactgcaacaggcttatgcggaagttggaccagatggggctgttacggtagaaccgggttggacacgtgcggataccttggatatcggcgaaggcttccgttatgaactgggatttctgtccccgggcttcgaaacagatccggttcgtcgtgccgctgacatcgagggtgcccgcgtgctgctgtatcatggtacggttactgacttcatggacctgattccgttgctggaagcagtgaatgaggctggtcaagcgctggtaattgcatgcgatggaatcgatgagcgtccgttacagggcttagtaatgaacgtcaagcgtggtgtgttccgtgcgctggcagtgaaagcgccgggccatggtgaccgtcgtcgtgattggctggatgatctggcgactgccacgggtgcccgcgtactggtgccggagcgcggagacaatctggaacgtgcggcaccggaagtgcttggacacgcggccaaagtggtggccgatgcggacagcgctagttttattggctgtggcggtgaccctgtggcagtagcccgtcgtgtggcgggattaggtaaagaggccgatgccattcgcgcgcgcaaaccgggcgaaggttctcctaccggcaatctgcatgatctggaggatctggaggcgcgcattagtgcgttagttggtcgcatcgctaccgtccgtgtaggcggcaccaccgagcccgaaattaaagaacgcttgcaacgcgctgaaaatgcccgtcgttcagttcgcgccgcgttggaggaaggagttgtgcctggcggtggagtgggactgcttcaagcccgcgaagccttaggtcgccttctcctgacggatctggactggcagcgcggcgtggctatcgtaagcgaagcactcgaacagccattccgtgctctggtcggaaacgcaggtatcaatccggtggcggccctggctcgtatcgaagcggcaggcaacgctcgttttggttacgatgccagctcaggagcgttcggtgatctcgtagcagccggtgtcttagacccagtgaaagtcctgcgcctggctctggttcaagctgcggggattgccgcgacagttctgtcttccggagcagtcgtgttgaatgagcagtcaggcttaccgcatctgcccggcttttccgcggaatgggccgcagcaacgcgcgaagatccgcgtgcctaa

SEQ ID NO: 134 - protein, 560 aa, Methylocaldum sp.175
MSKRLVFDGEARAGILKGIDILGRAVETTYGYQGPCVMVQHRTQGLPPFFTRDGVTVANSVVLGDRLADLGARMLRDVANAVSREAGDGTTTAVVLARAIARGLLRSLAAGADPHRLREGMDAAVKLVEDDLRRRALPLQGDMVAQVAEVSMRKEGQVGRLLQQAYAEVGPDGAVTVEPGWTRADTLDIGEGFRYELGFLSPGFETDPVRRAADIEGARVLLYHGTVTDFMDLIPLLEAVNEAGQALVIACDGIDERPLQGLVMNVKRGVFRALAVKAPGHGDRRRDWLDDLATATGARVLVPERGDNLERAAPEVLGHAAKVVADADSASFIGCGGDPVAVARRVAGLGKEADAIRARKPGEGSPTGNLHDLEDLEARISALVGRIATVRVGGTTEPEIKERLQRAENARRSVRAALEEGVVPGGGVGLLQAREALGRLLLTDLDWQRGVAIVSEALEQPFRALVGNAGINPVAALARIEAAGNARFGYDASSGAFGDLVAAGVLDPVKVLRLALVQAAGIAATVLSSGAVVLNEQSGLPHLPGFSAEWAAATREDPRA

SEQ ID NO: 135 - DNA, 288 bp, Artificial Sequence
  Synthetic plasmid
atggcgttccgcccgctgcatgatcgtgtggtcgttaagcgcctggagggtgaagataaaaccaaaggcggtattatcattccggatacagcgaaagaaaaaccggccgaaggcaaaatcatcgctgtaggaccgggcgcgcgcgatgaatcaggaaaattggtggcgcttgatgtcaaagaaggggaccgcgtgctgttcggaaagtggtcggggacagaggtaaaaattgatggcgaagatctgttaatcatgaaggaaagtgatattctgggcgttatcgcgtaa

SEQ ID NO: 136 - protein, 95 aa, Methylocystis sp. LW5; identical to SEQ ID NO: 120

SEQ ID NO: 137 - DNA, 1683 bp, Artificial Sequence
  Synthetic plasmid
atggcgcgtaatattcgctttggtgatccggtccgtaaacgtctgctggatggcgtggattttctggcggatgccgtgggggtgactctgggtccgtgtggtcgcaacgtcgtgattgaacatcgtgcaagcggcttgccgccagtagcgactaaagatggagcaacggttgcccaagctgtggaagctgcgggtcgtaccgagtctgtaggcatcaacttggtacgtcagatggcgaccaccgtggcgaaggaagcgggagatggtacaacgacgtccgtagtgttaacccgccgtgtcgcagccgaaacacgtaaggcattagcagcgggtatgaatccgcgtgatattaccctgggaatggagcgtgctgcccgtgcagtagaggcagatttgctccgccgcgcacgtcgctgcaacgaccagcgttctcttgcgcacgttgcgactctggccgctggtggagacgaaggcattggcgcaattgtggcccaagcgctggctttagctggggaaggtggtgtggtggatgtggaattaggtcacggtgtggccgacgacatcgaaagcgtcgaaggcatgcgctgggaacagggctaccgcagcccgtattttatgaccgatagcgctcgcaaagtggccgaactggaaaacccgtacattttagtttatgaccgtgtgattaacgagttttctgaactggtgccggcccttgagctggtccgccgctccgggggctctctgttagtagtggctgaaaacattatggaagaagctctcccgggtctgctgctgaatcatattcgcaaaaacctgtgtagcattgccgtgaagggccctggttatggcgattctcgctatgaatatttactggaccttgccgcgattaccggtggccgtgcaatcatggaagccttcggtgaagacatttcaaatgtcaccatggagcatctgggccgcgcacgtcgcgtcgtagtacgtgaagatgacacactggtcattggcggcgagggcgacccaaacgtgatcgccgaccgtctggcatccgcgaaacgtcaggccgattggattgtagaaggagacgcatcaaaaggcagcccgtccggcaaacgccacgaacttgaaaatcttcagacgcgcattaaagcacttagcggtcgcatggccaccatccgcgcgggtggcctctccgatgttcttatcaaagagcgcatgcaacgtattgaaaacgcgctgaatagtgctcgcgcggcgcagtccgatggcgttgtcgcgggtggtggcgtgggcctgtaccgcgctcgcgcagcgctggctgaactgcgcggcgaaaatctggaccagagccacggagttgcgattgtgcgtgccgcgctggatgagccgattcgtcgcattgcggcgaacgcgggcgttgatgcggatgagtttctgtttgaactgcgccgttcaaatgatgatttttggggtatggacatgcgtagtggcgcgtgcggagatctgtttgcagcgggtgtgattgatccagtccgcgttactcgcctggcgttacgcaacgcggtggctactgcggcttcgcttatgacggtggagtgcgcggttacccatattcccgtgagcgacccgacattcggctttgacgcgcgtcgcgcagccgagactcgtgaagatcctcgcgcctaa

SEQ ID NO: 138 - protein, 560 aa, Methylocystis sp. LW5; identical to SEQ ID NO: 122

SEQ ID NO: 139 - DNA, 291 bp, Artificial Sequence
  Synthetic plasmid
atgaaactgcgcccgctccatgaccgtgtaattgtcaaacgtctggaagaagaaaaaaaatccgccggcggaattatcatcccggatgccgcagcagaaaagccaagtcgtggtgaagtaatcagcgtggggccggggaaacgtggcgacgatggtaaactgaatgcactggatgtgaaagctggtgatattgttttattcggcaaatactctggtagtgaagtccgcgtagacggtcaagatttgctggttatgcgcgaagacgacattatggcggtttttgccaagtaa

SEQ ID NO: 140 - protein, 96 aa, Solimonas aquatica
MKLRPLHDRVIVKRLEEEKKSAGGIIIPDAAAEKPSRGEVISVGPGKRGDDGKLNALDVKAGDIVLFGKYSGSEVRVDGQDLLVMREDDIMAVFAK

SEQ ID NO: 141 - DNA, 1689 bp, Artificial Sequence
  Synthetic plasmid
atgacgaatggcaagaattgccgtgtctcggacggatttggtgccctgggcaaactgagcagtggcatgcgtatcctggcggaagtcgttgcagttaccctcggtccaggcggtcgccatgtgattctggaacatcgcagcggcttagctcctcgtctgagtaaggatggtgtcgagatcgcccgtactatggaagtggctggacgtgaagaagaaatgggtgtacgtctgttgcgcgatgcggcaatctcgattagcgctagcgtgggtgatggaacaactacagcgatcgtattgtcagctgcgctggccacgcgctgtatggctgcttccagccatccgcttaacgtctcggaaatgcgctacggattggctatggcgggggcgacagtgctctctgaattagctgccatggcgcgtccggccgatcaacatgccctgcaagcggtggcgcgcacagctgttaatggtgatgcgccgctggccgccctgcttgcggatgcctatgcccgcgtgggtagcgaaggtgttattaaaatcgagatgggtaatgcaatgcatgacgtgttagatgtgaagctcggacaccgcttcgaatccctgctgctggccagcggtctgccggctagtgcgggcgaacgtcaactcctgcgccctctgaccctgcttcacgacggcgaattggatgacctccaagcgctgattcctgcgatggagattgctcgtgccgaacaacgcccgcttctcattctggccggcgacgtcagcgatggcgtgcgcaccgcgattgtgcgtaacgctcgcgaaaatgtggtagatgttactgtagtgcgcgctccgatgtttggggatacccgtcaggaatgcctgggtgacctggccgcgctgtgcggaggatcagccttcgtggaaaacggatttcgcactattgcggccctgagccgcgatgatctgggcagcgtggatcgtgcggtggtagatgcgggaagcgctattctccacggagctcatggcgatgcacgcgaacgccaagaccgtatcgcgttgcttcgtagcgaaatggaaggtagtggtcgctcgacggcgtcgccgtctggccagctggatcatagcgacaagtgtcaagaacgcctgcagattctgcttggcgcgaccgcctcgttgcagctgggcggcgcaacggacgtcgcaatcaaagcccgcatgccgatcgccgaaaatgggcgccgcgcgttactggccgcagcgagcaccggcgtcctgccgggtggaggcgtggcgatgcttcgcgcagcactcgcggcacgttcgcgcctgtctactctgcaggacgacgcccgtctcggtgcagaggcgctcttgtcagcgctgcaggccccgttcgcatgggtcgttcgcaactcgggacaccaacctgaggaatgcctggatcgcgtgttgtctgaagcggattgctttcacggcctggacgccgcccgcgggtgttacggtgatctgcatgcggcgggagtgttagattcgttcttgatggtccgcaaaattgtgacggtggcgacctctatggccggtagcctgctgagcacgggtgccttagtgtgtcgtggcggggaaactgctctcccggaaaacttccaggggacacaacaggtgtaccgcaaattagcggcaggcggcgccttcgattcttaa

SEQ ID NO: 142 - protein, 562 aa, Solimonas aquatica
MTNGKNCRVSDGFGALGKLSSGMRILAEVVAVTLGPGGRHVILEHRSGLAPRLSKDGVEIARTMEVAGREEEMGVRLLRDAAISISASVGDGTTTAIVLSAALATRCMAASSHPLNVSEMRYGLAMAGATVLSELAAMARPADQHALQAVARTAVNGDAPLAALLADAYARVGSEGVIKIEMGNAMHDVLDVKLGHRFESLLLASGLPASAGERQLLRPLTLLHDGELDDLQALIPAMEIARAEQRPLLILAGDVSDGVRTAIVRNARENVVDVTVVRAPMFGDTRQECLGDLAALCGGSAFVENGFRTIAALSRDDLGSVDRAVVDAGSAILHGAHGDARERQDRIALLRSEMEGSGRSTASPSGQLDHSDKCQERLQILLGATASLQLGGATDVAIKARMPIAENGRRALLAAASTGVLPGGGVAMLRAALAARSRLSTLQDDARLGAEALLSALQAPFAWVVRNSGHQPEECLDRVLSEADCFHGLDAARGCYGDLHAAGVLDSFLMVRKIVTVATSMAGSLLSTGALVCRGGETALPENFQGTQQVYRKLAAGGAFDS

SEQ ID NO: 143 - DNA, 1581 bp, Artificial Sequence
  Synthetic plasmid
atggccatctctttagctaccaaagctgctaccgatgctttaaaagtaaaccgtgcccctgtcggtgttgaacctcaggaagtgcataaatggttgcaatccttcaactgggacttcaaggaaaaccgtacaaagtacgcaactaagtaccatatggcaaatcaaacaaaggaacaatttaaagtaattgcaaaagaatatgccagaatggaagccgctaaggatgaacgacaattcggcactttattagacggcttgactagattaggtgctggtaacaaggttcatcccagatggggtgagactatgaaggttatttctaacttcctggaagtaggtgaatacaatgctatcgctgcttcagctatgctgtgggattccgctacggccgcagaacagaagaacggttatttagcacaagtgctagatgagatccgtcatactcaccaatgcgcttttataaatcattattattctaaacactaccatgacccagctggccataacgatgcccgtcgtacacgagcaattggcccactatggaagggaatgaaaagagtttttgctgacggtttcatttcaggtgatgccgttgagtgcagtgttaacctacagctagtcggtgaggcttgtttcaccaatcctctaattgttgccgttactgagtgggcatcagccaatggggacgagataacaccaactgtttttttgtcagttgagacagacgaattgagacacatggccaatggatatcagacggttgttagtatagcaaatgacccagccgctgctaaataccttaacacagacttgaacaatgccttttggactcagcaaaaatactttacccctgctttgggctatttgtttgagtatggttctaagtttaaggtcgaaccctgggttaaaacatggaataggtgggtgtacgaggattggggtggtatttggattggtagactgggtaaatacggcgttgagtctcctaggtccttgcgtgatgccaagactgacgcctactgggctcatcacgacttagctcttgctgcctacgctctgtggccattaggatttgccagacttgcattgccagacgaggaggaccaagaatggttcgaggctaattatccagggtgggccgatcattacggaaagatttacaatgaatggaaaaaattaggctacgaggatcctaaatccggttttattccatacgcatggttgttgcaaaatggtcatgatgtctatatcgacagagtgtctcaagttccctttattccctccttagcaaaaggttcaggctcccttagggttcatgagtataacggaaagaagcattccttgacagatgattggggtgaaaggatgtggttgtctgagcctgaaaggtacgagtgtcactccattttcgagcaatacgagggaagagaactttctgaggttattgctgagggacacggggttaggtccgatggtaagactctgatcgctcagccacatgttagaggcgataatctttggactcttgaggacatcaagcgtgcaggttgtgtgttcccagaccctttggccaagttctaa

SEQ ID NO: 144 - protein, 526 aa, Methylocystis sp. LW5
MAISLATKAATDALKVNRAPVGVEPQEVHKWLQSFNWDFKENRTKYATKYHMANQTKEQFKVIAKEYARMEAAKDERQFGTLLDGLTRLGAGNKVHPRWGETMKVISNFLEVGEYNAIAASAMLWDSATAAEQKNGYLAQVLDEIRHTHQCAFINHYYSKHYHDPAGHNDARRTRAIGPLWKGMKRVFADGFISGDAVECSVNLQLVGEACFTNPLIVAVTEWASANGDEITPTVFLSVETDELRHMANGYQTVVSIANDPAAAKYLNTDLNNAFWTQQKYFTPALGYLFEYGSKFKVEPWVKTWNRWVYEDWGGIWIGRLGKYGVESPRSLRDAKTDAYWAHHDLALAAYALWPLGFARLALPDEEDQEWFEANYPGWADHYGKIYNEWKKLGYEDPKSGFIPYAWLLQNGHDVYIDRVSQVPFIPSLAKGSGSLRVHEYNGKKHSLTDDWGERMWLSEPERYECHSIFEQYEGRELSEVIAEGHGVRSDGKTLIAQPHVRGDNLWTLEDIKRAGCVFPDPLAKF

SEQ ID NO: 145 - DNA, 1188 bp, Artificial Sequence
  Synthetic plasmid
atgtctcagccacagtcttctcaggttaccaagaggggactgacggaccccgaaagggcagctatcatcgccgcagctattccagatcatgctttggatacccagcgtaaataccactatttcattcagcctagatggaagaggttaagtgaatatgagcagttgtcctgttacgcccaaccaaacccagattggattgctggtggtttggactggggtgactggactcagaagtttcatggtggtagaccctcttggggaaacgaatctactgaacttaggaccaccgattggtaccgacacagagatccagcacgtaggtggcacgcaccttacgtcaaagataagtctgaggaagctagatatacacagagattcttggcagcatactcatctgaaggttccattcgaaccgtcgacgcatattggagggacgaaattcttaacaaatattacggtgcattgttatataacgaatacggtttattcaatgctcactcttctgtgggcagggactctctgtctgatacaattaggcaatccgctatatttgctgctcttgataaggttgataacgcacaaatgattcaaatggaaagattatttattgcaaaattggtgccaggtttcgatgcttctacggatgtgcctaaaaagatctggacaacagatccaatttatgctggcgctagaggtgcagtcgaagagatttggcagggtattcaagattggaatgagatattgtgggccggtcacgccgtctacgatgctaccttcgggcaattcgctagaagggaattttttcaaagacttgctactgtatacggtgatacattgacccctttctttacagcccaatcacaaacttatttccaaattactagaggtgcaattgaggacctgtttgtctactcccttgctaacgaccccgaatttggagcccataacaggacttttctgaatgcatggactgaacattatcttgcaagatctgtgacagcattgaaggattttgttgggatctatgctaaggtggagaaagtggctggtgccactgacagagctggagtctctgaagcactacagagagtatttggggactggaaagtggattacgccgacaagatcggtttcaagattgacgtagaccagaaggtcgacgcagtactggcaggttacaaaaattaa

SEQ ID NO: 146 - protein, 395 aa, Methylocystis sp. LW5
MSQPQSSQVTKRGLTDPERAAIIAAAIPDHALDTQRKYHYFIQPRWKRLSEYEQLSCYAQPNPDWIAGGLDWGDWTQKFHGGRPSWGNESTELRTTDWYRHRDPARRWHAPYVKDKSEEARYTQRFLAAYSSEGSIRTVDAYWRDEILNKYYGALLYNEYGLFNAHSSVGRDSLSDTIRQSAIFAALDKVDNAQMIQMERLFIAKLVPGFDASTDVPKKIWTTDPIYAGARGAVEEIWQGIQDWNEILWAGHAVYDATFGQFARREFFQRLATVYGDTLTPFFTAQSQTYFQITRGAIEDLFVYSLANDPEFGAHNRTFLNAWTEHYLARSVTALKDFVGIYAKVEKVAGATDRAGVSEALQRVFGDWKVDYADKIGFKIDVDQKVDAVLAGYKN

SEQ ID NO: 147 - DNA, 510 bp, Artificial Sequence
  Synthetic plasmid
atggcaaagagggaacctattcacgaaaattccactcgtactgagtgggagggaaagatagctaaactgaactctgttgatcaggctactaagtttatccaagattttcgagttgctaattcctctccttttaggaagtcatatgatctagacgtggactaccaatatatcgagagaaagattgaagagagactgtccgtattaaagaccgaaaagttatcagttgccgatttagtcaccaaggccacgactggtgaagacgccgctgctgttgaagctacatggattgcaaagatgaaggcagccgagtctaaatatgcagccgaacgaattcatgttgaattcagacaattgtataagcctcctgttctaccagtgaatgttttcctgagaactgatgcagcattaggaactatcttaatggaacttagaaataccgactattatgctactcctttagaaggattgagaaaggagcgtggggttaaagttctacatcttcaggcatag

SEQ ID NO: 148 - protein, 169 aa, Methylocystis sp. LW5
MAKREPIHENSTRTEWEGKIAKLNSVDQATKFIQDFRVANSSPFRKSYDLDVDYQYIERKIEERLSVLKTEKLSVADLVTKATTGEDAAAVEATWIAKMKAAESKYAAERIHVEFRQLYKPPVLPVNVFLRTDAALGTILMELRNTDYYATPLEGLRKERGVKVLHLQA

SEQ ID NO: 149 - DNA, 417 bp, Artificial Sequence
  Synthetic plasmid
atgtcctcagcccacaacaactataatgccggtattatgcagaaatcaggaaaagcattcgccgatgaattcttcgcagaggagaaccaagtggtacatgaatcaaatgctgtcgttttggtcctgatgaagtctgatgaaatcgacgccatcatcgaagacatcatattgaaagggggtaaagctaaaaacccatccatcgttgttgaggacaaggctggattctggtggatcaaagcagatggagctatcgaaatcgatgctgctgaagctgctgatttactgggcaagccattctctgtttacgatttgctgatcaacgtttctagtaccgttggtcgtgcttacaccttgggcacgaaattcactatcactagtgaattaatgggattggatagagccttgacagatatttaa

SEQ ID NO: 150 - protein, 138 aa, Methylocystis sp. LW5
MSSAHNNYNAGIMQKSGKAFADEFFAEENQVVHESNAVVLVLMKSDEIDAIIEDIILKGGKAKNPSIVVEDKAGFWWIKADGAIEIDAAEAADLLGKPFSVYDLLINVSSTVGRAYTLGTKFTITSELMGLDRALTDI

SEQ ID NO: 151 - DNA, 1032 bp, Artificial Sequence
  Synthetic plasmid
atgtatcagatcgtgattgaaactgaagatggagaaacttgttccttcgagtgtgggccttctgaagatgtgatatccgctggacttaggcagtccgtcatcctgttaagttcctgccgagctgggggatgcgccacgtgcaaggccgattgtacggacggtgattatgagttgatcgacgtaaaggtacaggcactacctcctgatgaggaggaagatggtaaggtgttactttgcagaacctttcctcgatcagatttgcatttaatcgttccatacacttacgacaggatttcattcgaggcaatccagactaactggctggccgaaattgttgaatgcgatagagtatcttctaatgtagtcagacttgttctacagccactgaccgctgatggcgcagctccaatcgccttaaacttcgctcctggtcagtttgtcgatattgagatccccggtactcacaccagaagatcctacagtatggcatccgttgcagaggatgggcgtcttgaattctttattcgtcttttaccagatggagctttttctaagttcttgcaaacccaagctaaagtgggattaagagtcgccctacgtggacctgctggttcatttatgctgcataaatctgaaagaccacgtttcttcgttgctggaggcactggcttgtctcctgttttaagtatgataagacagttgaaaaaagaatccgatcagcaacccgctaccttgttctttggtgtaactaattatgaggagctgttttatgtcgaagaactgaaagctctacaaaacgctatgccctcccttgatgtgcaagtcgccgtcgttaatgcatctgaggctaatggtgttgccaagggaactgtgatagatcttatgagggccgaactggagaaacttagaggtaagccagacatttatttatgtggtcctcctgggatgattgaagcagcatttgatgctgctgccacagctggtgttcccaaagagcaagtctacctggagaaattcttggcttcaggctag

SEQ ID NO: 152 - protein, 343 aa, Methylocystis sp. LW5
MYQIVIETEDGETCSFECGPSEDVISAGLRQSVILLSSCRAGGCATCKADCTDGDYELIDVKVQALPPDEEEDGKVLLCRTFPRSDLHLIVPYTYDRISFEAIQTNWLAEIVECDRVSSNVVRLVLQPLTADGAAPIALNFAPGQFVDIEIPGTHTRRSYSMASVAEDGRLEFFIRLLPDGAFSKFLQTQAKVGLRVALRGPAGSFMLHKSERPRFFVAGGTGLSPVLSMIRQLKKESDQQPATLFFGVTNYEELFYVEELKALQNAMPSLDVQVAVVNASEANGVAKGTVIDLMRAELEKLRGKPDIYLCGPPGMIEAAFDAAATAGVPKEQVYLEKFLASG

SEQ ID NO: 153 - DNA, 336 bp, Artificial Sequence
  Synthetic plasmid
atggctcaatgtgccgagcaagccgcagaggaacaaagaattttgatccacgcagattctagatatgctgcatataccatggacttggactatatgtggcgttgggagatcctgagagacggtgagtttgttcaagaaggatgcagtctgtctcttgactcagcaagggaagctgtttcacatgttctgagattttttcagaggcaagacgaggctgccgcccgtccaggagacaattccgcagagattaagagattgcttcaatctttgggaaccccaattcctatcgacgatagaaacgaaaccacaaagaatgagttggctcaacctgaatag

SEQ ID NO: 154 - protein, 111 aa, Methylocystis sp. LW5
MAQCAEQAAEEQRILIHADSRYAAYTMDLDYMWRWEILRDGEFVQEGCSLSLDSAREAVSHVLRFFQRQDEAAARPGDNSAEIKRLLQSLGTPIPIDDRNETTKNELAQPE

The invention claimed is:

1. A synthetic polynucleotide for a soluble diiron monooxygenase enzyme which can be expressed in a microorganism of interest, comprising at least one monooxygenase coding region encoding a diiron monooxygenase enzyme comprising SEQ ID NO: 10 and at least one protein folding chaperone coding region encoding at least one protein folding chaperone, the at least one monooxygenase coding region linked to at least one promoter which will function in the microorganism of interest and allow the microorganism of interest to oxidize short chain alkanes and the at least one protein folding chaperone coding region linked to at least one promoter which will function in the microorganism of interest.

2. A synthetic microorganism comprising at least one exogenous synthetic polynucleotide of claim 1 and a microorganism.

3. The synthetic microorganism according to claim 2, wherein the microorganism is selected from the group consisting of *Escherichia coli, Saccharomyces cerevisiae, Pichia pastoris, Bacillus methanolicus, Bacillus subtilis,* and *Corynebacterium glutamicum.*

4. A synthetic microorganism comprising the synthetic polynucleotide of claim 1, wherein the at least one protein folding chaperone comprises groES/groEL and a microorganism.

5. The synthetic microorganism of claim 2, wherein the synthetic microorganism is capable of growth on a monooxygenase substrate as a sole or major carbon source.

6. The synthetic microorganism of claim 5, wherein the monooxygenase substrate is methane, ethane, propane, butane, or naphthalene.

7. The synthetic microorganism of claim 5, wherein the monooxygenase substrate is ethane and the microorganism is *Escherichia coli.*

8. The synthetic microorganism of claim 2, wherein the microorganism produces a chemical.

9. The synthetic microorganism of claim 8, wherein the chemical is methanol, ethanol, propanol, butanol, or naphthol.

10. A method for producing a chemical, comprising culturing the synthetic microorganism of claim 2 under suitable culture conditions and for a sufficient period of time to produce the chemical.

11. The method of claim 10, wherein the suitable conditions comprise a culture media containing at least one of methane, ethane, propane, butane, or naphthalene as a sole carbon source or as a major carbon source.

12. The method according to claim 10, wherein the synthetic microorganism of claim 7 is cultured under conditions such that the synthetic microorganism produces a chemical that is converted into a second chemical by a second microorganism or a second synthetic microorganism.

* * * * *